(12) United States Patent
Ticho et al.

(10) Patent No.: US 10,730,924 B2
(45) Date of Patent: Aug. 4, 2020

(54) POLYNUCLEOTIDES ENCODING RELAXIN

(71) Applicant: ModernaTX, Inc., Cambridge, MA (US)

(72) Inventors: Barry Ticho, Newton, MA (US); Nadege Briancon-Eris, Wellesley, MA (US); Zhinan Xia, Wellesley, MA (US); Athanasios Dousis, Boston, MA (US); Seymour de Picciotto, Boston, MA (US); Vladimir Presnyak, Hooksett, NH (US); Stephen Hoge, Brookline, MA (US); Iain Mcfadyen, Arlington, MA (US); Kerry Benenato, Sudbury, MA (US); Ellalahewage Sathyajith Kumarasinghe, Harvard, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 16/025,302

(22) Filed: Jul. 2, 2018

(65) Prior Publication Data
US 2018/0371047 A1 Dec. 27, 2018

Related U.S. Application Data

(63) Continuation of application No. PCT/US2017/033411, filed on May 18, 2017.

(60) Provisional application No. 62/338,470, filed on May 18, 2016.

(51) Int. Cl.
| | | |
|---|---|---|
| *C12N 15/62* | (2006.01) |
| *A61K 47/14* | (2017.01) |
| *C07K 14/64* | (2006.01) |
| *A61K 31/7105* | (2006.01) |
| *A61K 47/69* | (2017.01) |
| *A61P 9/00* | (2006.01) |
| *A61K 38/17* | (2006.01) |
| *C07K 16/26* | (2006.01) |
| *C12N 15/52* | (2006.01) |
| *A61K 9/127* | (2006.01) |
| *A61K 38/00* | (2006.01) |
| *A61K 9/00* | (2006.01) |

(52) U.S. Cl.
CPC .......... *C07K 14/64* (2013.01); *A61K 31/7105* (2013.01); *A61K 38/1796* (2013.01); *A61K 47/6929* (2017.08); *A61P 9/00* (2018.01); *C07K 16/26* (2013.01); *C12N 15/52* (2013.01); *C12N 15/62* (2013.01); *A61K 9/0019* (2013.01); *A61K 9/127* (2013.01); *A61K 38/00* (2013.01); *C07K 2319/00* (2013.01); *C07K 2319/31* (2013.01)

(58) Field of Classification Search
None
See application file for complete search history.

(56) References Cited

U.S. PATENT DOCUMENTS

| | | |
|---|---|---|
| 4,758,516 A | 7/1988 | Hudson et al. |
| 4,871,670 A | 10/1989 | Hudson et al. |
| 5,023,321 A | 6/1991 | Hudson et al. |
| 5,053,488 A | 10/1991 | Hudson et al. |
| 5,145,962 A | 9/1992 | Hudson et al. |
| 5,179,195 A | 1/1993 | Hudson et al. |
| 5,320,953 A | 6/1994 | Hudson et al. |
| 5,326,694 A | 7/1994 | Hudson et al. |
| 5,703,055 A | 12/1997 | Felgner et al. |
| 6,924,365 B1 | 8/2005 | Miller et al. |
| 8,058,069 B2 | 11/2011 | Yaworski et al. |
| 8,158,601 B2 | 4/2012 | Chen et al. |
| 8,178,660 B2 | 5/2012 | Weiner et al. |
| 8,278,036 B2 | 10/2012 | Kariko et al. |
| 8,389,475 B2 | 3/2013 | Park et al. |
| 8,450,298 B2 | 5/2013 | Mahon et al. |
| 8,569,256 B2 | 10/2013 | Heyes et al. |
| 8,642,076 B2 | 2/2014 | Manoharan et al. |
| 8,691,750 B2 | 4/2014 | Constein et al. |
| 8,710,200 B2 | 4/2014 | Schrum et al. |
| 8,754,062 B2 | 6/2014 | De Fougerolles et al. |
| 8,822,663 B2 | 9/2014 | Schrum et al. |

(Continued)

FOREIGN PATENT DOCUMENTS

| | | |
|---|---|---|
| EP | 0204401 | 12/1986 |
| EP | 2292771 | 3/2011 |

(Continued)

OTHER PUBLICATIONS

U.S. Appl. No. 15/239,613, filed Aug. 17, 2016, Laska et al.

(Continued)

*Primary Examiner* — Christopher M Babic
*Assistant Examiner* — Arthur S Leonard
(74) *Attorney, Agent, or Firm* — Finnegan, Henderson, Farabow, Garrett & Dunner, LLP

(57) ABSTRACT

The invention relates to mRNA therapy for the treatment of fibrosis and/or cardiovascular disease. mRNAs for use in the invention, when administered in vivo, encode human relaxin, isoforms thereof, functional fragments thereof, and fusion proteins comprising relaxin. mRNAs of the invention are preferably encapsulated in lipid nanoparticles (LNPs) to effect efficient delivery to cells and/or tissues in subjects, when administered thereto. mRNA therapies of the invention increase and/or restore deficient levels of relaxin expression and/or activity in subjects. mRNA therapies of the invention further decrease levels of toxic metabolites associated with deficient relaxin activity in subjects.

21 Claims, 10 Drawing Sheets
Specification includes a Sequence Listing.

(56) References Cited

U.S. PATENT DOCUMENTS

| | | |
|---|---|---|
| 8,999,380 B2 | 4/2015 | Bancel et al. |
| 9,221,891 B2 | 12/2015 | Bancel et al. |
| 9,303,079 B2 | 4/2016 | Bancel et al. |
| 9,382,305 B2 * | 7/2016 | Wilmen ................ C07K 14/64 |
| 9,452,222 B2 | 9/2016 | Kraynov et al. |
| 9,464,124 B2 | 10/2016 | Bancel et al. |
| 9,512,456 B2 | 12/2016 | Wang et al. |
| 9,597,380 B2 | 3/2017 | Chakraborty et al. |
| 9,868,691 B2 | 1/2018 | Benenato et al. |
| 9,872,900 B2 | 1/2018 | Ciaramella et al. |
| 10,064,934 B2 | 9/2018 | Ciaramella et al. |
| 10,064,935 B2 | 9/2018 | Ciaramella et al. |
| 10,166,298 B2 * | 1/2019 | Ansell ................... A61K 47/18 |
| 2003/0083272 A1 | 5/2003 | Wiederholt et al. |
| 2006/0083780 A1 | 4/2006 | Heyes et al. |
| 2009/0093433 A1 | 4/2009 | Woolf et al. |
| 2009/0286852 A1 | 11/2009 | Kariko et al. |
| 2011/0077287 A1 | 3/2011 | Von Der Mulbe et al. |
| 2011/0086904 A1 | 4/2011 | Russell |
| 2011/0200582 A1 | 8/2011 | Baryza et al. |
| 2011/0243942 A1 | 10/2011 | Wang |
| 2011/0244026 A1 | 10/2011 | Guild et al. |
| 2011/0256175 A1 | 10/2011 | Hope et al. |
| 2012/0046346 A1 | 2/2012 | Rossi et al. |
| 2012/0172411 A1 | 7/2012 | Heyes et al. |
| 2012/0295832 A1 | 11/2012 | Constien et al. |
| 2013/0017223 A1 | 1/2013 | Hope et al. |
| 2013/0064894 A1 | 3/2013 | Martin et al. |
| 2013/0065942 A1 | 3/2013 | Matar et al. |
| 2013/0090372 A1 | 4/2013 | Budzik et al. |
| 2013/0102034 A1 | 4/2013 | Schrum et al. |
| 2013/0111615 A1 | 5/2013 | Kariko et al. |
| 2013/0115274 A1 | 5/2013 | Knopov et al. |
| 2013/0116307 A1 | 5/2013 | Heyes et al. |
| 2013/0156845 A1 | 6/2013 | Manoharan et al. |
| 2013/0171241 A1 | 7/2013 | Geall |
| 2013/0177639 A1 | 7/2013 | Geall et al. |
| 2013/0177640 A1 | 7/2013 | Geall et al. |
| 2013/0178541 A1 | 7/2013 | Stanton et al. |
| 2013/0189351 A1 | 7/2013 | Geall |
| 2013/0195967 A1 | 8/2013 | Guild et al. |
| 2013/0195969 A1 | 8/2013 | Geall et al. |
| 2013/0197068 A1 | 8/2013 | Kariko et al. |
| 2013/0243848 A1 | 9/2013 | Lobovkina et al. |
| 2013/0259923 A1 | 10/2013 | Bancel et al. |
| 2013/0266640 A1 | 10/2013 | De Fougerolles et al. |
| 2014/0147432 A1 | 5/2014 | Bancel et al. |
| 2014/0147454 A1 | 5/2014 | Chakraborty et al. |
| 2014/0148390 A1 | 5/2014 | Haupts et al. |
| 2014/0148502 A1 | 5/2014 | Bancel et al. |
| 2014/0193482 A1 | 7/2014 | Bancel et al. |
| 2014/0206752 A1 | 7/2014 | Afeyan et al. |
| 2014/0378538 A1 | 12/2014 | Bancel |
| 2015/0141499 A1 | 5/2015 | Bancel et al. |
| 2015/0307542 A1 | 10/2015 | Roy et al. |
| 2015/0315541 A1 | 11/2015 | Bancel et al. |
| 2015/0329613 A1 | 11/2015 | Wilmen et al. |
| 2016/0024141 A1 | 1/2016 | Issa et al. |
| 2016/0038612 A1 | 2/2016 | Hoge et al. |
| 2016/0237156 A1 | 8/2016 | Wang et al. |
| 2016/0317647 A1 | 11/2016 | Ciaramella et al. |
| 2017/0340724 A1 | 11/2017 | Ciaramella et al. |
| 2018/0002393 A1 | 1/2018 | Bancel et al. |
| 2018/0028664 A1 | 2/2018 | Besin et al. |
| 2018/0237849 A1 | 8/2018 | Thompson |
| 2018/0243225 A1 | 8/2018 | Ciaramella |
| 2018/0243230 A1 | 8/2018 | Smith |

FOREIGN PATENT DOCUMENTS

| | | |
|---|---|---|
| WO | WO 1999/14346 A2 | 3/1999 |
| WO | WO 2003/030930 A1 | 4/2003 |
| WO | WO 2006/074341 A2 | 7/2006 |
| WO | WO 2007/024708 A2 | 3/2007 |
| WO | WO 2007/064952 A2 | 3/2007 |
| WO | WO 2008/042973 A2 | 4/2008 |
| WO | WO 2008/052770 A2 | 5/2008 |
| WO | WO 2008/083949 A2 | 7/2008 |
| WO | WO2008/096158 | 8/2008 |
| WO | WO 2009/127060 A1 | 10/2009 |
| WO | WO 2009/127230 A1 | 10/2009 |
| WO | WO 2010/042877 A1 | 4/2010 |
| WO | WO 2010/054406 A1 | 5/2010 |
| WO | WO 2010/088537 A3 | 8/2010 |
| WO | WO2010/094722 | 8/2010 |
| WO | WO2010/094723 | 8/2010 |
| WO | WO 2010/144710 A1 | 12/2010 |
| WO | WO 2010/144740 A1 | 12/2010 |
| WO | WO 2011/005799 A2 | 1/2011 |
| WO | WO 2011/017108 A2 | 2/2011 |
| WO | WO 2011/068810 A1 | 6/2011 |
| WO | WO 2011/071931 A2 | 6/2011 |
| WO | WO 2012/006359 A1 | 1/2012 |
| WO | WO 2012/006378 A1 | 1/2012 |
| WO | WO 2012/006380 A2 | 1/2012 |
| WO | WO 2012/019630 A1 | 2/2012 |
| WO | WO 2012/019780 A1 | 2/2012 |
| WO | WO 2012/031043 A1 | 3/2012 |
| WO | WO 2012/045082 A2 | 4/2012 |
| WO | WO 2012/075040 A2 | 6/2012 |
| WO | WO 2012/099755 A1 | 7/2012 |
| WO | WO 2012/116715 A1 | 9/2012 |
| WO | WO 2012/138453 A1 | 10/2012 |
| WO | WO 2012/170889 A1 | 12/2012 |
| WO | WO 2012/170930 A1 | 12/2012 |
| WO | WO 2013/033563 A1 | 3/2013 |
| WO | WO 2013/059496 A1 | 4/2013 |
| WO | WO 2013/063468 A1 | 5/2013 |
| WO | WO 2013/078199 A2 | 5/2013 |
| WO | WO 2013/086373 A1 | 6/2013 |
| WO | WO 2013/087083 A1 | 6/2013 |
| WO | WO 2013/090186 A1 | 6/2013 |
| WO | WO 2013/090601 A2 | 6/2013 |
| WO | WO 2013/135359 A1 | 9/2013 |
| WO | WO 2013/143555 A1 | 10/2013 |
| WO | WO 2013/143683 A1 | 10/2013 |
| WO | WO 2013/151666 A2 | 10/2013 |
| WO | WO 2013/185069 A1 | 12/2013 |
| WO | WO 2014/008334 A1 | 1/2014 |
| WO | WO 2014/089486 A1 | 6/2014 |
| WO | WO 2014/093574 A1 | 6/2014 |
| WO | WO 2014/110368 A1 | 7/2014 |
| WO | WO 2014/152774 A1 | 9/2014 |
| WO | WO 2014/152940 A1 | 9/2014 |
| WO | WO 2014/160243 A1 | 10/2014 |
| WO | WO 2015/006744 A1 | 1/2015 |
| WO | WO 2015/110957 A2 | 7/2015 |
| WO | WO 2015/157829 A1 | 10/2015 |
| WO | WO 2015/164786 A1 | 10/2015 |
| WO | WO 2015/188132 A1 | 12/2015 |
| WO | WO2015/199952 A1 | 12/2015 |
| WO | WO 2016/118697 A1 | 7/2016 |
| WO | WO 2016/164762 A1 | 10/2016 |
| WO | WO 2016/201377 A1 | 12/2016 |
| WO | WO 2017/015457 A1 | 1/2017 |
| WO | WO 2017/015463 A1 | 1/2017 |
| WO | WO 2017/019935 A1 | 2/2017 |
| WO | WO 2017/020026 A1 | 2/2017 |
| WO | WO 2017/062513 A1 | 4/2017 |
| WO | WO 2017/070601 A1 | 4/2017 |
| WO | WO 2017/070616 A1 | 4/2017 |
| WO | WO 2017/070618 A1 | 4/2017 |
| WO | WO 2017/070620 A1 | 4/2017 |
| WO | WO 2017/070622 A1 | 4/2017 |
| WO | WO 2017/070623 A1 | 4/2017 |
| WO | WO 2017/201340 A1 | 11/2017 |
| WO | WO 2017/201342 A1 | 11/2017 |
| WO | WO 2017/201347 A1 | 11/2017 |
| WO | WO 2018/053209 A1 | 3/2018 |
| WO | WO 2018/075980 A1 | 4/2018 |
| WO | WO 2018/081459 A1 | 5/2018 |
| WO | WO 2018/081462 A1 | 5/2018 |
| WO | WO 2018/089851 A1 | 5/2018 |
| WO | WO 2018/107088 A1 | 6/2018 |

(56) References Cited

FOREIGN PATENT DOCUMENTS

| WO | WO 2018/111967 A1 | 6/2018 |
|---|---|---|
| WO | WO 2018/144082 A1 | 8/2018 |
| WO | WO 2018/144778 A1 | 8/2018 |
| WO | WO 2018/151816 A1 | 8/2018 |
| WO | WO 2018/170245 A1 | 9/2018 |
| WO | WO 2018/170256 A1 | 9/2018 |
| WO | WO 2018/170260 A1 | 9/2018 |
| WO | WO 2018/170270 A1 | 9/2018 |
| WO | WO 2018/170347 A1 | 9/2018 |

OTHER PUBLICATIONS

U.S. Appl. No. 16/036,318, filed Jul. 16, 2018, Ciaramella et al.
U.S. Appl. No. 16/048,154, filed Jul. 27, 2018, Ciaramella et al.
U.S. Appl. No. 90/014,167, filed Aug. 17, 2018, Ciaramella et al.
U.S. Appl. No. 15/748,773, filed Jan. 30, 2018, Ciaramella et al.
U.S. Appl. No. 15/155,986, filed May 16, 2016, Fritz.
U.S. Appl. No. 15/753,293, filed Feb. 17, 2018, Smith.
U.S. Appl. No. 15/753,297, filed Feb. 17, 2018, Thompson.
U.S. Appl. No. 15/748,782, filed Jan. 30, 2018, Mousavi et al.
U.S. Appl. No. 16/001,751, filed Jun. 6, 2018, Mousavi et al.
U.S. Appl. No. 15/156,249, filed May 16, 2016, Miracco.
U.S. Appl. No. 15/767,587, filed Apr. 11, 2018, Ciaramella.
U.S. Appl. No. 16/006,526, filed Jun. 12, 2018, Ciaramella.
U.S. Appl. No. 15/767,600, filed Apr. 11, 2018, Ciaramella et al.
U.S. Appl. No. 16/023,013, filed Jun. 29, 2018, Ciaramella et al.
U.S. Appl. No. 15/769,710, filed Apr. 19, 2018, Ciaramella et al.
U.S. Appl. No. 15/767,609, filed Apr. 11, 2018, Ciaramella et al.
U.S. Appl. No. 15/767,613, filed Apr. 11, 2018, Ciaramella et al.
U.S. Appl. No. 15/767,618, filed Apr. 11, 2018, Ciaramella et al.
U.S. Appl. No. 15/674,585, filed Aug. 11, 2017, Ciaramella et al.
U.S. Appl. No. 16/136,386, filed Sep. 20, 2018, Ciaramella et al.
U.S. Appl. No. 15/674,591, filed Aug. 11, 2017, Ciaramella et al.
U.S. Appl. No. 16/136,503, filed Sep. 20, 2018, Ciaramella et al.
U.S. Appl. No. 15/746,286, filed Jan. 19, 2018, Ciaramella et al.
U.S. Appl. No. 16/009,811, filed Jun. 15, 2018, Ciaramella et al.
U.S. Appl. No. 16/009,848, filed Jun. 15, 2018, Ciaramella et al.
U.S. Appl. No. 16/009,880, filed Jun. 15, 2018, Ciaramella et al.
U.S. Appl. No. 15/981,762, filed May 16, 2018, Bancel et al.
U.S. Appl. No. 15/905,576, filed Feb. 26, 2018, Bancel et al.
U.S. Appl. No. 15/387,263, filed Dec. 21, 2016, Chen et al.
U.S. Appl. No. 15/674,107, filed Aug. 10, 2017, Besin et al.
U.S. Appl. No. 15/674,872, filed Aug. 11, 2017, Besin et al.
U.S. Appl. No. 16/001,786, filed Jun. 6, 2018, Hoge et al.
U.S. Appl. No. 16/040,981, filed Jul. 20, 2018, Ciaramella et al.
U.S. Appl. No. 16/001,765, filed Jun. 6, 2018, Marquardt et al.
U.S. Appl. No. 15/880,436, filed Jan. 25, 2018, Ciaramella.
U.S. Appl. No. 16/031,951, filed Jul. 10, 2018, Ciaramella.
U.S. Appl. No. 16/131,793, filed Sep. 14, 2018, Ciaramella et al.
PCT/US2017/033411, Jan. 2, 2018, International Search Report and Written Opinion.
International Search Report and Written Opinion for Application No. PCT/US2017/03341, dated Jan. 2, 2018.
Anderson et al., Incorporation of pseudouridine into mRNA enhances translation by diminishing PKR activation. Nucleic Acids Res. Sep. 2010;38(17):5884-92. doi: 10.1093/nar/gkq347. Epub May 10, 2010.
Anderson et al., Nucleoside modifications in RNA limit activation of 2'-5'-oligoadenylate synthetase and increase resistance to cleavage by Rnase L. Nucleic Acids Res. 2011; 1-10.
Andries et al., Comparison of the gene transfer efficiency of mRNA/GL67 and pDNA/GL67 complexes in respiratory cells. Mol Pharmaceutics. 2012; 9: 2136-2145.
Aota et al., Diversity in G+C content at the third position of codons in vertebrate genes and its cause. Nucleic Acids Res. Aug. 26, 1986;14(16):6345-55.
Bates et al., Detection of Familial Hypercholesterolaemia: A Major Treatment Gap in Preventative Cardiology, Heart, Lung and Circulation 2008;17:411-413.

Bathgate et al., Relaxin family peptides and their receptors. Physiol Rev. Jan. 2013;93(1):405-80. doi: 10.1152/physrev.00001.2012.
Belliveau, N.M., et al., Microfluidic synthesis of highly potent limit-size lipid nanoparticles for in vivo delivery of siRNA. Mol Ther Nucleic Acids. Aug. 2012; 1(8): e37.
Bondi et al., Solid lipid nanoparticles for applications in gene therapy: a review of the state of the art. Expert Opin Drug Deliv. Jan. 2010;7(1):7-18. doi: 10.1517/17425240903362410. Review.
Daguer, J.P. et al., Increasing the stability of sacB transcript improves levansucrase production in Bacillus subtilis. Lett Appl Microbial. 2005;41 (2):221-6.
Deering et al., Nucleic Acid Vaccines: Prospects for Non-Viral Delivery of mRNA Vaccines, Expert Opinion, 2014, vol. 11, No. 6, pp. 1-15.
Delehanty. Peptides for Specific Intracellular Delivery and Targeting of Nanoparticles: Implications for Developing Nanoparticle-Mediated Drug Delivery, Future Science, Therapeutic Delivery, 2010, vol. 1, No. 3, pp. 411-433.
Felgner, PL Cationic lipid/polynucleotide condensates for in vitro and in vivo polynucleotide delivery—the cytofectins. J. of Liposome Research. 1993; 3(1): 3-16.
Felgner, PL Particulate systems and polymers for in vitro and in vivo delivery of polynucleotides. Adv. Drug Delivery Rev. 1990; 5(3): 163-187.
Felgner, PL, et al., Lipofection: a highly efficient, lipid-mediated DNA-transfection procedure. Proc Natl Acad Sci U SA. Nov. 1987;84(21):7413-7.
Garber et al.; A sensitive and convenient method for lipoprotein profile analysis of individual mouse plasma samples. Journal of Lipid Research. 2000. 14: 1020-1026.
Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.
Grosjean, H., Modification and editing of RNA: historical overview and important facts to remember. Fine-tuning of RNA functions by modification and editing. Topics Curr Gen. Jan. 2005; 12: 1-22.
Grundy et al., Promise of Low-Density Lipoprotein-Lowering Therapy for Primary and Secondary Prevention, Circulation Journal of the American Heart Association, 2008, vol. 117, pp. 569-573.
Hoerr, More than a messenger: A new class of drugs—mRNA-based therapeutics. Genetic Engineering & Biotechnology News. Jun. 18, 2013. http://www.genengnews.com/gen-articles/more-than-a-messenger-a-new-class-of-drugs-mrna-based-therapeutics/4916/ [last accessed Mar. 25, 2016].
Hofman et al., CYP7A1 A-278C Polymorphism Affects the Response of Plasma Lipids after Dietary Cholesterol or Cafestol Interventions in Humans, The Journal of Nutrition, 2004, pp. 2200-2204.
Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.
Kariko et al., Increased erythropoiesis in mice injected with submicrogram quantities of pseudouridine-containing mRNA encoding erythropoietin. Mol Ther. May 2012; 20(5): 948-953.
Kariko et al. Naturally occurring nucleoside modifications suppress the immunostimulatory activity of RNA: Implication for therapeutic RNA development. Current Opinion in Drug Discovery & Development 2007 10(5) 523-532; The Thomson Corporation ISSN 1367-6733.
Kariko et al., Generating the optimal mRNA for therapy: HPLC purification eliminates immune activation and improves translation of nucleoside-modified, protein-encoding mRNA, Nucleic Acids Research, Oxford University Press, GB, vol. 39, No. 21, Sep. 2, 2011 (Sep. 2, 2011), e142. doi: 10.1093/nar/gkr695. Epub Sep. 2, 2011.
Kariko et al., Incorporation of pseudouridine into mRNA yields superior nonimmunogenic vector with increased translational capacity and biological stability. Mol Ther. Nov. 2008; 16(11):1833-40. Epub Sep. 16, 2008.
Kariko et al., Suppression of RNA recognition by Toll-like receptors: the impact of nucleoside modification and the evolutionary origin of RNA. Immunity. Aug. 2005;23(2):165-75.

(56) References Cited

OTHER PUBLICATIONS

Kauffman et al., Optimization of Lipid Nanoparticle Formulations for mRNA Delivery in Vivo with Fractional Factorial and Definitive Screening Designs. Nano Lett. Nov. 11, 2015;15(11):7300-6. doi: 10.1021/acs.nanolett.5b02497. Epub Oct. 20, 2015.
Kobayashi et al., Roles of the WHHL Rabbit in Translational Research on Hypercholesterolemia and Cardiovascular Diseases, Journal of Biomedicine and Biotechnology, vol. 2011, Article ID 406473, pp. 1-10.
Kuhn, A.N., et al., mRNA as a versatile tool for exogenous protein expression. Current Gene Therapy. Oct. 2012; 12 (5): 347-361.
Malone, R.W. et al., Cationic liposome-mediated RNA transfection. Proc Natl Acad Sci U SA. Aug. 1989;86 (16):6077-81.
Paik et al., The adenoviral gene delivery of relaxin show antifibrotic effect in thioacetaminde-induced liver cirrhosis in rats. Journal of Hepatology. Mar. 2011;54:S417. Supplement 1. Abstract No. 1051.
Parisien et al., Rationalization and prediction of selective decoding of pseudouridine-modified nonsense and sense codons. RNA. Mar. 2012;18(3):355-67. doi: 10.1261/rna.031351.111. Epub Jan. 26, 2012.
Rejman, J., et al., mRNA transfection of cervical carcinoma and mesenchymal stem cells mediated by cationic carriers. J Controlled Rel. Nov. 2010; 147(3): 385-391.
Sahin et al., mRNA-based therapeutics—developing a new class of drugs. Nat Rev Drug Discov. Oct. 2014;13(10):759-80. doi: 10.1038/nrd4278. Epub Sep. 19, 2014.
Semple, S.C., et al., Rational design of cationic lipids for siRNA delivery. Nat Biotechnol. Feb. 2010; 28(2): 172-176.
Sohn, R.L., et al., In-vivo particle mediated delivery of mRNA to mammalian tissues: ballistic and biological effects. Wound Rep and Regen. Jul.-Aug. 2001; 287-296.
Sullenger, BA et al., Emerging clinical applications of RNA. Nature. Jul. 11, 2002;418(6894):252-8.
Tavernier, G., et al., mRNA as gene therapeutic: How to control protein expression. J. of Controlled Release. Mar. 2011; 150(3): 238-247.
Uzgun, S., et al., PEGylation improves nanoparticle formation and transfection efficiency of messenger RNA. Pharm Res. Sep. 2011; 28(9); 2223-2232.
Wan et al., Lipid nanoparticle delivery systems for siRNA-based therapeutics. Drug Deliv Transl Res. Feb. 2014;4(1):74-83. doi:10.1007/s13346-013-0161-z.
Yamamoto, A., et al., Current prospects for mRNA gene delivery. Eur J Pharm Biopharm. Mar. 2009; 71 (3): 484-489.
Zangi et al., Modified mRNA directs the fate of heart progenitor cells and indices vascular regeneration after myocardial infarction, Nature Biology, Advanced Online Publication, May 10, 2013, pp. 1-9.
Zohra, F.T., et al., Drastic effect of nanoapatite particles on liposome-mediated mRNA delivery to mammalian cells. Analytical Biochem. Oct. 2005; 345(1): 164-166.
Sabnis, et al., "A Novel Amino Lipid Series for mRNA Delivery: Improved Endosomal Escape and Sustained Pharmacology and Safety in Non-human Primates," Molecular Therapy, vol. 26, No. 6, Jun. 2018, American Society of Gene and Cell Therapy (33 pages).

* cited by examiner

Fig. 1

Wild type relaxin

B chain
A chain

"VLk"-hRLN2 variant

B chain
A chain | (G4S)3-VLk

Fig. 2 m1Ψ Wildtype RLN2
EC50: 20 ng/mL

Recombinant human RLN2 protein
EC50: 379 ng/mL mo5U Construct 1
EC50: 26 ng/mL

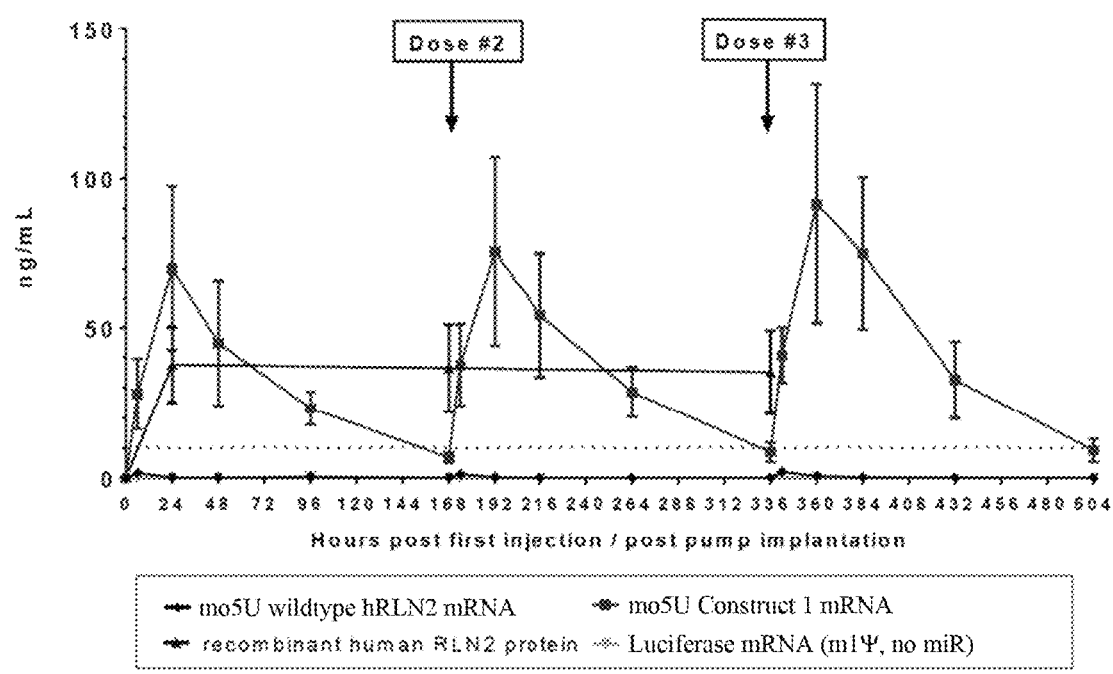

Fig. 5
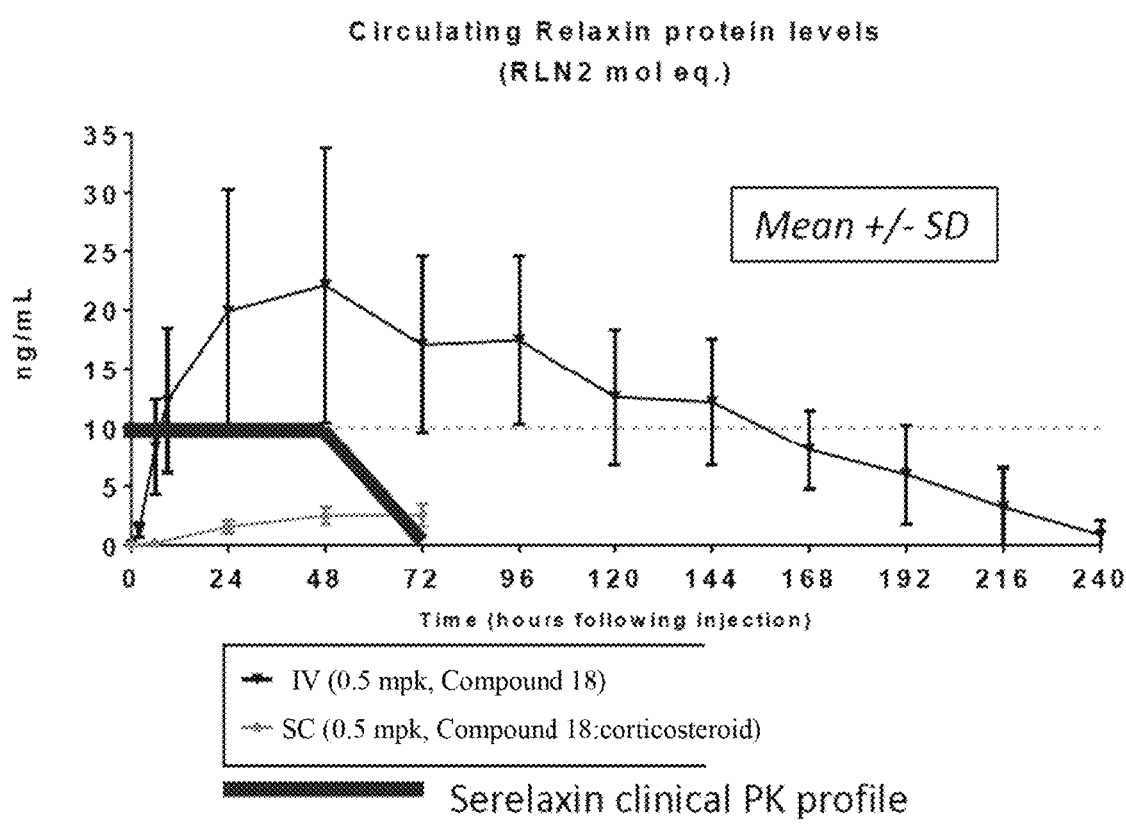
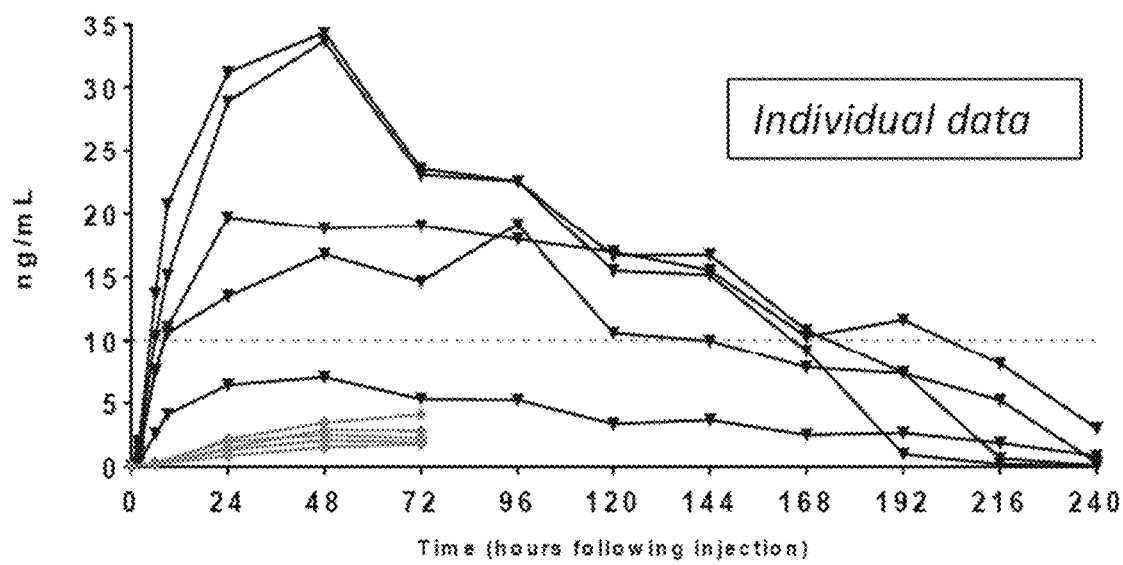

POLYNUCLEOTIDES ENCODING RELAXIN

RELATED APPLICATIONS

This Application is a Continuation of International Patent Application Serial No. PCT/US2017/033411, filed May 18, 2017, entitled "POLYNUCLEOTIDES ENCODING RELAXIN", which claims the benefit under 35 U.S.C. § 119(e) of U.S. provisional application 62/338,470 filed May 18, 2016, which are incorporated by reference herein in their entirety.

BACKGROUND

Acute heart failure (AHF) is a sudden decline, resulting when the heart cannot pump enough blood to meet the cardiac demands of the body. Signs and symptoms can include dyspnea, edema, and fatigue, which can lead to acute respiratory distress and death. AHF, as well as other cardiovascular diseases, can be caused by deficiency in circulating relaxin.

Relaxin is a 6000 Da heterodimeric polypeptide endocrine and autocrine/paracrine hormone, belonging to the insulin gene superfamily. Relaxin facilitates angiogenesis and contributes to the repair of vascular endothelium. It exerts its effects on the musculoskeletal and other systems through binding its receptor in different tissues, a process mediated by different signaling pathways. There are seven known relaxin family peptides, including relaxin (RLN)1, RLN2, RLN3, and insulin-like peptide (INSL)3, INSL4, INSL5, INSL6. RLN1 and RLN2 are involved in collagen regulation and metabolism in fibroblasts, while RLN3 is specific to the brain. RLN1 and RLN2 are also involved in the hemodynamic changes that occur during pregnancy, including cardiac output, renal blood flow, and arterial compliance. Further, RLN2 mediates vasodilation through increased production of nitric oxide through a phosphorylation cascade. Relaxin is also a cardiac stimulant, and it can cause vasodilation through the inhibition of angiotensin II and endothelin, two potent vasoconstrictors. The hormone has also been shown to increase calcium sensitivity of cardiac myofilaments and increase phosphorylation of the myofilaments by protein kinase C. The force generated by the myofilaments increases while the energy consumption of the cardiac myocytes does not. In the kidneys, relaxin increases creatinine clearance and increases renal blood flow.

Relaxin, a vasoactive peptide, protects the vascular system from overwork, increases renal function, promotes cell growth and survival, and maintains good vessel structure. The administration of relaxin to a subject has therapeutic benefits such as treating and preventing fibrosis e.g., renal fibrosis, cardiac fibrosis or pulmonary fibrosis and cardiovascular disease e.g., acute heart failure, coronary artery disease, microvascular disease, acute coronary syndrome with cardiac dysfunction, or ischemia reperfusion.

The standard of care therapy for many of the disorders associated with relaxin deficiency include beta blockers, hydralazine/isorbide dinitrate, digitalis, diuretics, angiotensin-converting enzyme (ACE) inhibitors, angiotensin-receptor blockers (ARB), digoxin, anticoagulants, aldosterone antagonists, and medications to control co-morbidies, including, but not limited to, high cholesterol, high blood pressure, atrial fibrillation, and diabetes. Lifestyle modifications, including diet and exercise, are also typically recommended.

Although relaxin provides significant therapeutic benefits, recombinant wild type relaxin has a short half-life which makes the achievement of therapeutic levels in the body a challenge. A recombinant form of relaxin referred to as Serelaxin and marketed by Novartis, has been demonstrated to have low toxicity, however, the efficacy has been questionable because it is degraded so quickly in the bloodstream. Serelaxin has a half-life of about 15 minutes in serum and 7-8 hours during continuous 48 hour infusion.

SUMMARY OF THE INVENTION

The present invention provides mRNA therapeutics for the treatment of fibrosis and/or cardiovascular disease. The mRNA therapeutics of the invention are particularly well-suited for the treatment of fibrosis and/or cardiovascular disease, as the technology provides for the intracellular delivery of mRNA encoding relaxin (RXN) followed by de novo synthesis of functional RXN protein within target cells. The instant invention features the incorporation of modified nucleotides within therapeutic mRNAs to (1) minimize unwanted immune activation (e.g., the innate immune response associated with the in vivo introduction of foreign nucleic acids) and (2) optimize the translation efficiency of mRNA to protein. Exemplary aspects of the invention feature a combination of nucleotide modification to reduce the innate immune response and sequence optimization, in particular, within the open reading frame (ORF) of therapeutic mRNAs encoding RXN to enhance protein expression.

The mRNA therapeutic technology of the instant invention also features delivery of mRNA encoding RXN via a lipid nanoparticle (LNP) delivery system. The instant invention features novel ionizable lipid-based LNPs which have improved properties when administered in vivo, for example, cellular uptake, intracellular transport, and/or endosomal release or endosomal escape. The LNPs of the invention also demonstrate reduced immunogenicity associated with the in vivo administration of LNPs.

In certain aspects, the invention relates to compositions and delivery formulations comprising a polynucleotide, e.g., a ribonucleic acid (RNA), e.g., a messenger RNA (mRNA), encoding a therapeutic relaxin protein and methods for treating heart failure and/or other disorders in a subject in need thereof by administering the same.

Aspects of the invention relate to an RNA polynucleotide comprising an open reading frame (ORF) encoding a relaxin polypeptide. The relaxin polypeptide may be modified to promote enhanced half-life. For instance the relaxin polypeptide may be part of a fusion protein.

The compositions may be formulated in a ionizable lipid nanoparticle, wherein the ionizable lipid nanoparticle has a molar ratio of about 20-60% ionizable lipid:about 5-25% non-cationic lipid:about 25-55% sterol; and about 0.5-15% PEG-modified lipid. Some aspects of the invention relate to an RNA polynucleotide comprising an open reading frame (ORF) encoding a Relaxin polypeptide formulated in a ionizable lipid nanoparticle.

Other aspects of the invention relate to an RNA polynucleotide comprising an open reading frame (ORF) encoding a relaxin polypeptide formulated in a ionizable lipid nanoparticle, wherein the RNA polynucleotide in the ionizable lipid nanoparticle has a therapeutic index of greater than 10% of the therapeutic index of the RNA polynucleotide alone.

In some aspects the invention is a composition of an RNA polynucleotide having an open reading frame encoding at least one relaxin protein formulated in a ionizable lipid nanoparticle, wherein the ionizable lipid nanoparticle has a molar ratio of about 20-60% ionizable lipid: about 5-25% non-cationic lipid: about 25-55% sterol; and about 0.5-15% PEG-modified lipid.

In other aspects the invention is a nucleic acid comprising an RNA polynucleotide having an open reading frame encoding at least one relaxin fusion protein.

In yet other aspects the invention is a polypeptide, comprising a relaxin-VL fusion protein, wherein relaxin is fused to a variable light chain fragment.

In some embodiments the relaxin polypeptide has an amino acid sequence having at least 80% sequence identity to SEQ ID NO. 2. In other embodiments the polypeptide has an amino acid sequence having at least 90% sequence identity to SEQ ID NO. 2.

In some embodiments the relaxin protein is a relaxin fusion protein. The relaxin fusion protein may be an immunoglobulin (Ig) fragment. In some embodiments the Ig fragment is a variable chain fragment. In other embodiments the Ig fragment is a constant chain fragment. In some embodiments the Ig fragment is a variable light chain fragment. In some embodiments the variable light chain fragment a VLκ IgG region. In some embodiments the relaxin is linked to the VLκ IgG region through a linker.

The relaxin protein is a fusion protein and has a nucleotide sequence that is 81%-100% identical to the sequence of SEQ ID NO. 1 in some embodiments. In other embodiments the relaxin protein is a fusion protein and has a nucleotide sequence that is 85%-99% identical to the sequence of SEQ ID NO. 1.

In other aspects a method of treating a disorder associated with relaxin in a subject in need thereof is provided. The method involves administering to the subject a therapeutically effective amount of an RNA polynucleotide comprising an open reading frame (ORF) encoding a relaxin polypeptide in order to treat the disorder associated with relaxin.

In some embodiments the method of treating the disorder associated with relaxin involves a single administration of the RNA polynucleotide. In some embodiments the method of treating the disorder associated with relaxin further comprises administering a weekly dose.

In embodiments the disorder associated with relaxin is selected from the group consisting of acute coronary syndrome with cardiac dysfunction, ischemia reperfusion associated with solid organ transplantation, such as lung, kidney, liver, heart, Cardiopulmonary bypass organ protection including renal, and corneal healing, chronic heart failure, diabetic nephropathy, NASH, atrial fibrillation, cardiac fibrosis, diabetic wound healing and cirrhosis.

In other aspects the invention is a method of treating heart failure in a subject in need thereof, comprising administering to the subject a therapeutically effective amount of an RNA polynucleotide comprising an open reading frame (ORF) encoding a relaxin polypeptide in order to treat the heart failure.

In some embodiments the method involves a single administration of the RNA polynucleotide. In other embodiments the method further comprises administering a weekly dose, a dose every two weeks, a dose every three weeks, a dose every month, or a dose every two months.

In some embodiments the administration of the RNA polynucleotide with a ionizable lipid increases the therapeutic index of the RNA polynucleotide in the composition relative to the therapeutic index of the RNA polynucleotide alone in the absence of the ionizable lipid. In other embodiments the therapeutic index of the RNA polynucleotide in the composition is greater than 10:1 or 50:1.

In some embodiments upon administration to the subject the RNA polynucleotide is in a dosage form that exhibits a pharmacokinetic (PK) profile comprising: a) a $T_{max}$ at about 30 to about 240 minutes after administration; and b) a plasma drug (relaxin polypeptide produced by RNA polynucleotide) concentration plateau of at least 50% $C_{max}$ for a duration of about 60 to about 240 minutes. In other embodiments upon administration to the subject at least a 25% or 50% increase in circulating relaxin relative to baseline levels is achieved. Recombinant wild type relaxin has a short half-life; for example, Serelaxin, a recombinant form of relaxin, has a half-life of just 15 minutes in serum. However, as demonstrated in Examples 14 and 15, in vivo models have demonstrated embodiments of the present disclosure have significantly longer half-lives, making them more therapeutically efficacious.

In yet other embodiments the circulating relaxin level is achieved for 2 hours up to 7 days, for up to 5 days, or for up to 3 days.

In some embodiments upon administration to the subject the dosage form exhibits a PK profile wherein at least about 90% of drug is cleared from plasma within about 5 to 7 days of the plasma drug concentration plateau.

In other embodiments, the RNA comprises at least one chemical modification. In some embodiments, the chemical modification is selected from pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thiodihydropseudouridine, 2-thio-dihydrouridine, 2-thiopseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine and 2'-O-methyl uridine.

In some embodiments, the RNA polynucleotide formulated in the ionizable lipid nanoparticle has a therapeutic index of greater than 60% of the therapeutic index of the RNA polynucleotide alone. In some embodiments, the RNA polynucleotide formulated in the ionizable lipid nanoparticle has a therapeutic index of greater than 10% of the therapeutic index of the RNA polynucleotide alone.

In other embodiments, the ionizable lipid is a lipid of Formula (I):

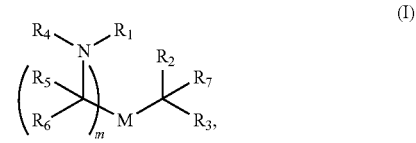

or a salt or isomer thereof, wherein:

$R_1$ is selected from the group consisting of $C_{5\text{-}30}$ alkyl, $C_{5\text{-}20}$ alkenyl, —R*YR", —YR", and —R"M'R';

$R_2$ and $R_3$ are independently selected from the group consisting of H, $C_{1\text{-}14}$ alkyl, $C_{2\text{-}14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3\text{-}6}$ carbocycle, —(CH$_2$)$_n$Q, —(CH$_2$)$_n$CHQR,
—CHQR, —CQ(R)$_2$, and unsubstituted $C_{1\text{-}6}$ alkyl, where Q is selected from a carbocycle, heterocycle, —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N (R)$_2$, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(R)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)N(R)$_2$, —C(=NR$_9$)R, —C(O)N(R)O R, and —C(R)N(R)$_2$C(O)OR, and each n is independently selected from 1, 2, 3, 4, and 5;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

R$_7$ is selected from the group consisting of C$_{1-3}$ alkyl, C$_{2-3}$ alkenyl, and H;

R$_8$ is selected from the group consisting of C$_{3-6}$ carbocycle and heterocycle;

R$_9$ is selected from the group consisting of H, CN, NO$_2$, C$_{1-6}$ alkyl, —OR, —S(O)$_2$R, —S(O)$_2$N(R)$_2$, C$_{2-6}$ alkenyl, C$_{3-6}$ carbocycle and heterocycle;

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13.

In some embodiments, a subset of compounds of Formula (I) includes those in which when R$_4$ is —(CH$_2$)$_n$Q, —(CH$_2$)$_n$CHQR, —CHQR, or —CQ(R)$_2$, then (i) Q is not —N(R)$_2$ when n is 1, 2, 3, 4 or 5, or (ii) Q is not 5, 6, or 7-membered heterocycloalkyl when n is 1 or 2. In some embodiments, a subset of compounds of Formula (I) includes those in which R$_1$ is selected from the group consisting of C$_{5-30}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle;

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and a 5- to 14-membered heterocycloalkyl having one or more heteroatoms selected from N, O, and S which is substituted with one or more substituents selected from oxo (=O), OH, amino, mono- or di-alkylamino, and C$_{1-3}$ alkyl, and each n is independently selected from 1, 2, 3, 4, and 5;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$-, —S—S—, an aryl group, and a heteroaryl group;

R$_7$ is selected from the group consisting of C$_{1-3}$ alkyl, C$_{2-3}$ alkenyl, and H;

R$_8$ is selected from the group consisting of C$_{3-6}$ carbocycle and heterocycle;

R$_9$ is selected from the group consisting of H, CN, NO$_2$, C$_{1-6}$ alkyl, —OR, —S(O)$_2$R, —S(O)$_2$N(R)$_2$, C$_{2-6}$ alkenyl, C$_{3-6}$ carbocycle and heterocycle;

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13, or salts or isomers thereof.

In other embodiments, a subset of compounds of Formula (I) includes those in which R$_1$ is selected from the group consisting of C$_{5-30}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle;

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heterocycle having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5; and when Q is a 5- to 14-membered heterocycle and (i) R$_4$ is —(CH$_2$)$_n$Q in which n is 1 or 2, or (ii) R$_4$ is —(CH$_2$)$_n$CHQR in which n is 1, or (iii) R$_4$ is —CHQR, and —CQ(R)$_2$, then Q is either a 5- to 14-membered heteroaryl or 8- to 14-membered heterocycloalkyl;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle; each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR, —CHQR, —CQ(R)$_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, —N(R)R$_8$, —O(CH$_2$)$_n$OR, —N(R)C(=NR$_9$)N(R)$_2$, —N(R)C(=CHR$_9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$, —N(OR)C(=NR$_9$)N(R)$_2$, —N(OR)C(=CHR$_9$)N(R)$_2$, —C(=NR$_9$)R, —C(O)N(R)OR, and —C(=NR$_9$)N(R)$_2$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, NO$_2$, $C_{1-6}$ alkyl, —OR, —S(O)$_2$R, —S(O)$_2$N(R)$_2$, $C_{2-6}$ alkenyl, $C_{3-6}$ carbocycle and heterocycle; each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In some embodiments, a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —(CH$_2$)$_n$Q or —(CH$_2$)$_n$CHQR, where Q is —N(R)$_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or isomers thereof.

In other embodiments, a subset of compounds of Formula (I) includes those in which $R_1$ is selected from the group consisting of $C_{5-30}$ alkyl, $C_{5-20}$ alkenyl, —R*YR", —YR", and —R"M'R';

$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —(CH$_2$)$_n$Q, —(CH$_2$)$_n$CHQR, —CHQR, and —CQ(R)$_2$, where Q is —N(R)$_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;
each R" is independently selected from the group consisting of $C_{3-14}$ alkyl and $C_{3-14}$ alkenyl;
each R* is independently selected from the group consisting of $C_{1-12}$ alkyl and $C_{1-12}$ alkenyl;
each Y is independently a $C_{3-6}$ carbocycle;
each X is independently selected from the group consisting of F, Cl, Br, and I; and
m is selected from 5, 6, 7, 8, 9, 10, 11, 12, and 13,
or salts or isomers thereof.

In some embodiments, a subset of compounds of Formula (I) includes those of Formula (IA):

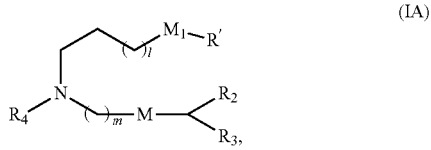

(IA)

or a salt or isomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_nQ$, in which Q is OH, —NHC(S)N(R)$_2$, —NHC(O)N(R)$_2$, —N(R)C(O)R, —N(R)S(O)$_2$R, —N(R)R$_8$, —NHC(=NR$_9$)N(R)$_2$, —NHC(=CHR$_9$)N(R)$_2$, —OC(O)N(R)$_2$, —N(R)C(O)OR, heteroaryl or heterocycloalkyl; M and M' are independently selected
from —C(O)O—, —OC(O)—, —C(O)N(R')—, —P(O)(OR')O—, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, the nanoparticle has a polydispersity value of less than 0.4. In some embodiments, the nanoparticle has a net neutral charge at a neutral pH.

In some embodiments, 80% of the uracil in the open reading frame have a chemical modification. In some embodiments, 100% of the uracil in the open reading frame have a chemical modification. In some embodiments, the chemical modification is in the 5-position of the uracil. In some embodiments, the chemical modification is N1-methylpseudouridine. In other embodiments, the uracil and thymine content of the RNA polynucleotide is 100-150% greater than that of wild-type relaxin polynucleotides.

Aspects of the invention relate to a method of increasing the therapeutic index of an RNA polynucleotide comprising an open reading frame (ORF) encoding a relaxin polypeptide, the method comprising associating the RNA polynucleotide with a ionizable lipid to produce a composition, thereby increasing the therapeutic index of the RNA polynucleotide in the composition relative to the therapeutic index of the RNA polynucleotide alone.

In some embodiments, the therapeutic index of the RNA polynucleotide in the composition is greater than 10:1. In other embodiments, the therapeutic index of the RNA polynucleotide in the composition is greater than 50:1.

Further aspects of the invention relate to a method for treating a subject comprising administering to a subject in need thereof the composition produced in an effective amount to treat the subject.

Aspects of the invention relate to a method of treating heart failure and/or other disorders in a subject in need thereof, comprising administering to the subject a therapeutically effective amount of an RNA polynucleotide comprising an open reading frame (ORF) encoding a relaxin polypeptide wherein administration of the RNA polynucleotide results in an increase in the subject's deficient protein to a physiological level.

In some embodiments, the method of treating heart failure and/or other disorders involves a single administration of the RNA polynucleotide. In some embodiments, the method of treating heart failure and/or other disorders further comprises administering a weekly dose. In other embodiments, the RNA polynucleotide is formulated in a ionizable lipid nanoparticle.

In some embodiments, the RNA polynucleotide is in a composition as previously described. In some embodiments, upon administration to the subject the dosage form exhibits a pharmacokinetic (PK) profile comprising: a) a $T_{max}$ at about 30 to about 240 minutes after administration; and b) a plasma drug (relaxin polypeptide produced by RNA polynucleotide) concentration plateau of at least 50% $C_{max}$ for a duration of about 90 to about 240 minutes.

In some embodiments, upon administration to the subject at least a 25% increase in relaxin protein level relative to baseline levels is achieved. In other embodiments, upon administration to the subject at least a 50% increase in relaxin protein level relative to baseline levels is achieved.

In some embodiments, upon administration to the subject at least a 60% increase in relaxin protein level relative to baseline levels is achieved. In other embodiments, the relaxin protein level increase is achieved for up to 3 days. In other embodiments, the relaxin protein level increase is achieved for up to 5 days.

In some embodiments, relaxin protein level increase is achieved for up to 7 days. In some embodiments, relaxin protein level increase is achieved within 1 hour of dosing the subject. In other embodiments, relaxin protein level increase is achieved within 3 hours of dosing the subject.

In some embodiments, the RNA polynucleotide is administered 1 per week for 3 weeks to 1 year. In some embodiments, the RNA polynucleotide is administered to the subject by intravenous administration. In some embodiments, the RNA polynucleotide is administered to the subject by subcutaneous administration.

Some embodiments further comprise administering to the subject a standard of care therapy for heart failure. In other embodiments, the standard of care therapy is selected from the group consisting of beta blockers, hydralazine/isorbide dinitrate, *digitalis*, diuretics, angiotensin-converting enzyme (ACE) inhibitors, angiotensin-receptor blockers (ARB), digoxin, anticoagulants, aldosterone antagonists, and medications to control co-morbidities, including, but not limited to, high cholesterol, high blood pressure, atrial fibrillation, and diabetes.

In some embodiments, the RNA polynucleotide is present in a dosage of between 25 and 100 micrograms. In other embodiments, the method comprises administering to the subject a single dosage of between 0.001 mg/kg and 0.005 mg/kg of the RNA polynucleotide.

Aspects of the invention relate to a method of treating heart failure and/or disorders in a subject in need thereof, comprising administering to the subject an RNA polynucleotide comprising an open reading frame (ORF) encoding a relaxin polypeptide and a standard of care therapy for heart failure and/or other disorders wherein the combined administration of the RNA polynucleotide and standard of care therapy results in an increase in the subject's relaxin protein levels to a physiological level.

The present disclosure provides a polynucleotide comprising an open reading frame (ORF) encoding a relaxin polypeptide, wherein the uracil or thymine content of the ORF is between 100% and about 150% of the theoretical minimum uracil or thymine content of a nucleotide sequence encoding the relaxin polypeptide (% $U_{TM}$ or % $T_{TM}$, respectively). In some embodiments, the uracil or thymine content in the ORF is between about 105% and about 145%, about 105% and about 140%, about 110% and about 145%, about 110% and about 140%, about 115% and about 145%, about 115% and about 140%, about 120% and about 145%, about 120% and about 140%, about 125% and about 145%, or about 125% and about 140% of the % $U_{TM}$ or % $T_{TM}$. In some embodiments, the uracil or thymine content in the ORF is between (i) 115%, 116%, 117%, 118%, 119%, 120%, 121%, 122%, 123%, 124%, or 125% and (ii) 139%, 140%, 141%, 142%, 143%, 144%, or 145% of the % $U_{TM}$ or % $T_{TM}$.

In some embodiments, the ORF further comprises at least one low-frequency codon.

In some embodiments, the ORF has at least 80%, at least 81%, at least 82%, at least 83%, at least 84%, at least 85%, at least 90%, at least 91%, at least 92%, at least 93%, at least 94%, at least 95%, at least 96%, at least 97%, at least 98%, at least 99%, or 100% sequence identity to a sequence selected from the sequences in Table 5. In some embodiments, the relaxin polypeptide comprises an amino acid sequence at least about 95%, at least about 96%, at least about 97%, at least about 98%, at least about 99%, or about 100% identical to the polypeptide sequence of the wild type relaxin protein (Table 5), and wherein the relaxin polypeptide has therapeutic activity. In some embodiments, the relaxin polypeptide is a variant, derivative, or mutant having a therapeutic activity. In some embodiments, the polynucleotide sequence further comprises a nucleotide sequence encoding a transit peptide.

In some embodiments, the polynucleotide further comprises a miRNA binding site. In some embodiments, the miRNA binding site comprises one or more nucleotide sequences selected from TABLE 4. In some embodiments, the miRNA binding site binds to miR-142. In some embodiments, the miRNA binding site binds to miR-142-3p or miR-142-5p. In some embodiments, the miR142 comprises SEQ ID NO: 539.

In some embodiments, the polynucleotide further comprises a 5' UTR. In some embodiments, the 5' UTR comprises a nucleic acid sequence at least 90%, at least about 95%, at least about 96%, at least about 97%, at least about 98%, at least about 99%, or about 100% identical to a sequence selected from the group consisting of SEQ ID NO: 545-569, or any combination thereof. In some embodiments, the polynucleotide further comprises a 3' UTR. In some embodiments, the 3' UTR comprises a nucleic acid sequence at least about 90%, at least about 95%, at least about 96%, at least about 97%, at least about 98%, at least about 99%, or about 100% identical to a sequence selected from the group consisting of SEQ ID NO: 493-505 and 570-587, or any combination thereof. In some embodiments, the miRNA binding site is located within the 3' UTR.

In some embodiments, the polynucleotide further comprises a 5' terminal cap. In some embodiments, the 5' terminal cap comprises a Cap0, Cap1, ARCA, inosine, N1-methyl-guanosine, 2'-fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof. In some embodiments, the polynucleotide further comprises a poly-A region. In some embodiments, the poly-A region is at least about 10, at least about 20, at least about 30, at least about 40, at least about 50, at least about 60, at least about 70, at least about 80, or at least about 90 nucleotides in length. In some embodiments, the poly-A region has about 10 to about 200, about 20 to about 180, about 50 to about 160, about 70 to about 140, about 80 to about 120 nucleotides in length.

In some embodiments, upon administration to a subject, the polynucleotide has: (i) a longer plasma half-life; (ii) increased expression of a relaxin polypeptide encoded by the ORF; (iii) a lower frequency of arrested translation resulting in an expression fragment; (iv) greater structural stability; or (v) any combination thereof, relative to a corresponding polynucleotide comprising the wild type relaxin polynucleotide.

In some embodiments, the polynucleotide comprises: (i) a 5'-terminal cap; (ii) a 5'-UTR; (iii) an ORF encoding a relaxin polypeptide; (iv) a 3'-UTR; and (v) a poly-A region. In some embodiments, the 3'-UTR comprises a miRNA binding site.

The present disclosure also provides a method of producing the polynucleotide described herein, the method comprising modifying an ORF encoding a relaxin polypeptide by substituting at least one uracil nucleobase with an adenine, guanine, or cytosine nucleobase, or by substituting at least one adenine, guanine, or cytosine nucleobase with a uracil nucleobase, wherein all the substitutions are synonymous substitutions. In some embodiments, the method further comprises replacing at least about 90%, at least about 95%, at least about 99%, or about 100% of uracils with 5-methoxyuracils.

In certain embodiments, a subset of compounds of Formula (I) includes those of Formula (IIa), (IIb), (IIc), or (IIe):

(IIa)

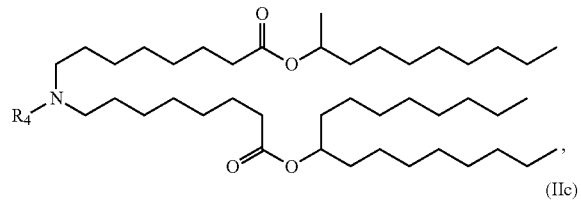
(IIb)

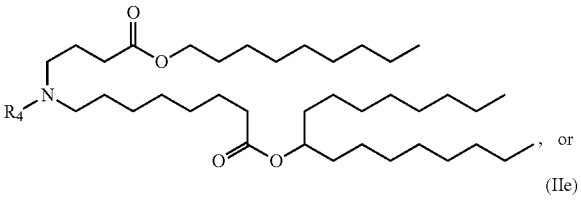
(IIc)

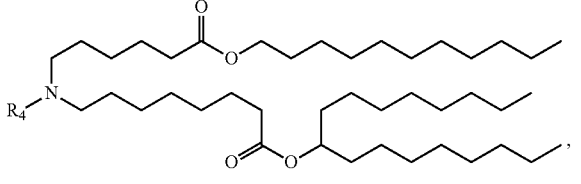
(IIe)

or a salt or isomer thereof, wherein $R_4$ is as described herein.

In some embodiments, $R_4$ is as described herein.

In some embodiments, the compound is of the Formula (IId),

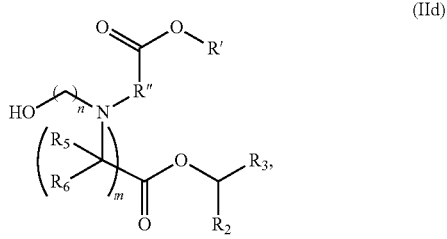

or a salt or stereoisomer thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined in claim 16.

In some embodiments, $R_2$ is $C_8$ alkyl. In some embodiments, $R_3$ is $C_5$ alkyl, $C_6$ alkyl, $C_7$ alkyl, $C_8$ alkyl, or $C_9$ alkyl. In some embodiments, m is 5, 7, or 9. In some embodiments, each $R_5$ is H. In some embodiments, each $R_6$ is H.

In another aspect, the disclosure features a nanoparticle composition including a lipid component comprising a compound as described herein (e.g., a compound according to Formula (I), (IA), (II), (IIa), (IIb), (IIc), (IId) or (IIe)).

In yet another aspect, the disclosure features a pharmaceutical composition comprising a nanoparticle composition according to the preceding aspects and a pharmaceutically acceptable carrier. For example, the pharmaceutical composition is refrigerated or frozen for storage and/or shipment (e.g., being stored at a temperature of 4° C. or lower, such as a temperature between about −150° C. and about 0° C. or between about −80° C. and about −20° C. (e.g., about −5° C., −10° C., −15° C., −20° C., −25° C., −30° C., −40° C., −50° C., −60° C., −70° C., −80° C., −90° C., −130° C. or −150° C.). For example, the pharmaceutical composition is a solution that is refrigerated for storage and/or shipment at, for example, about −20° C., −30° C., −40° C., −50° C., −60° C., −70° C., or −80° C.

In another aspect, the disclosure provides a method of delivering a therapeutic and/or prophylactic (e.g., an mRNA) to a cell (e.g., a mammalian cell). This method includes the step of administering to a subject (e.g., a mammal, such as a human) a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic, in which administering involves contacting the cell with the nanoparticle composition, whereby the therapeutic and/or prophylactic is delivered to the cell.

In another aspect, the disclosure provides a method of producing a polypeptide of interest in a cell (e.g., a mammalian cell). The method includes the step of contacting the cell with a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) an mRNA encoding the polypeptide of interest, whereby the mRNA is capable of being translated in the cell to produce the polypeptide.

In another aspect, the disclosure provides a method of treating a disease or disorder in a mammal (e.g., a human) in need thereof. The method includes the step of administering to the mammal a therapeutically effective amount of a nanoparticle composition including (i) a lipid component including a phospholipid (such as a polyunsaturated lipid), a PEG lipid, a structural lipid, and a compound of Formula (I), (IA), (II), (IIa), (IIb), (IIc), (IId) or (IIe) and (ii) a therapeutic and/or prophylactic (e.g., an mRNA). In some embodiments, the disease or disorder is characterized by dysfunctional or aberrant protein or polypeptide activity.

In another aspect, the disclosure provides a method of delivering (e.g., specifically delivering) a therapeutic and/or prophylactic to a mammalian organ (e.g., a liver, spleen, lung, or femur). This method includes the step of administering to a subject (e.g., a mammal) a nanoparticle composition including (i) a lipid component including a phospholipid, a PEG lipid, a structural lipid, and a compound of Formula (I), (IA), (II), (IIa), (IIb), (IIc), (IId) or (IIe) and (ii) a therapeutic and/or prophylactic (e.g., an mRNA), in which administering involves contacting the cell with the nanoparticle composition, whereby the therapeutic and/or prophylactic is delivered to the target organ (e.g., a liver, spleen, lung, or femur).

In another aspect, the disclosure features a method for the enhanced delivery of a therapeutic and/or prophylactic (e.g., an mRNA) to a target tissue (e.g., a liver, spleen, lung, muscle, or femur). This method includes administering to a subject (e.g., a mammal) a nanoparticle composition, the composition including (i) a lipid component including a compound of Formula (I), (IA), (II), (IIa), (IIb), (IIc), (IId) or (IIe), a phospholipid, a structural lipid, and a PEG lipid; and (ii) a therapeutic and/or prophylactic, the administering including contacting the target tissue with the nanoparticle composition, whereby the therapeutic and/or prophylactic is delivered to the target tissue In some embodiments, the composition disclosed herein is a nanoparticle composition. In some embodiments, the delivery agent further comprises a phospholipid. In some embodiments, the phospholipid is selected from the group consisting of
1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine, 1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine, 1,2-dioleoyl-sn-glycero-3-phospho-rac-(1-glycerol) sodium salt (DOPG), sphingomyelin, and any mixtures thereof.

In some embodiments, the delivery agent further comprises a structural lipid. In some embodiments, the structural lipid is selected from the group consisting of cholesterol, fecosterol, sitosterol, ergosterol, campesterol, stigmasterol, brassicasterol, tomatidine, ursolic acid, alpha-tocopherol, and any mixtures thereof.

In some embodiments, the delivery agent further comprises a PEG lipid. In some embodiments, the PEG lipid is selected from the group consisting of a PEG-modified phosphatidylethanolamine, a PEG-modified phosphatidic acid, a PEG-modified ceramnide, a PEG-modified dialkylamine, a PEG-modified diacylglycerol, a PEG-modified dialkylglycerol, and any mixtures thereof.

In some embodiments, the delivery agent further comprises an ionizable lipid selected from the group consisting of 3-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLin-DMA),
2,2-dilinoleyl-4-dimethylaminomethyl-[1,3]-dioxolane (DLin-K-DMA),
heptatriaconta-6,9,28,31-tetraen-19-yl 4-(dimethylamino)butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and
(2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)).

In some embodiments, the delivery agent further comprises a phospholipid, a structural lipid, a PEG lipid, or any combination thereof.

In some embodiments, the composition is formulated for in vivo delivery. In some embodiments, the composition is formulated for intramuscular, subcutaneous, or intradermal delivery.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing", "involving", and variations thereof herein, is meant to encompass the items listed thereafter and equivalents thereof as well as additional items.

BRIEF DESCRIPTION OF THE DRAWINGS/FIGURES

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

FIG. 1 is a schematic depicting wild-type relaxin and a "VLk"-hRLN2 fusion protein. The $(G_4S)_3$ sequence corresponds to SEQ ID NO: 589.

FIG. 2 is a series of graphs showing that the VLk-RLN2 fusion protein mRNA produces a functional protein in an in vitro proof-of-activity assay.

Figure 3A:
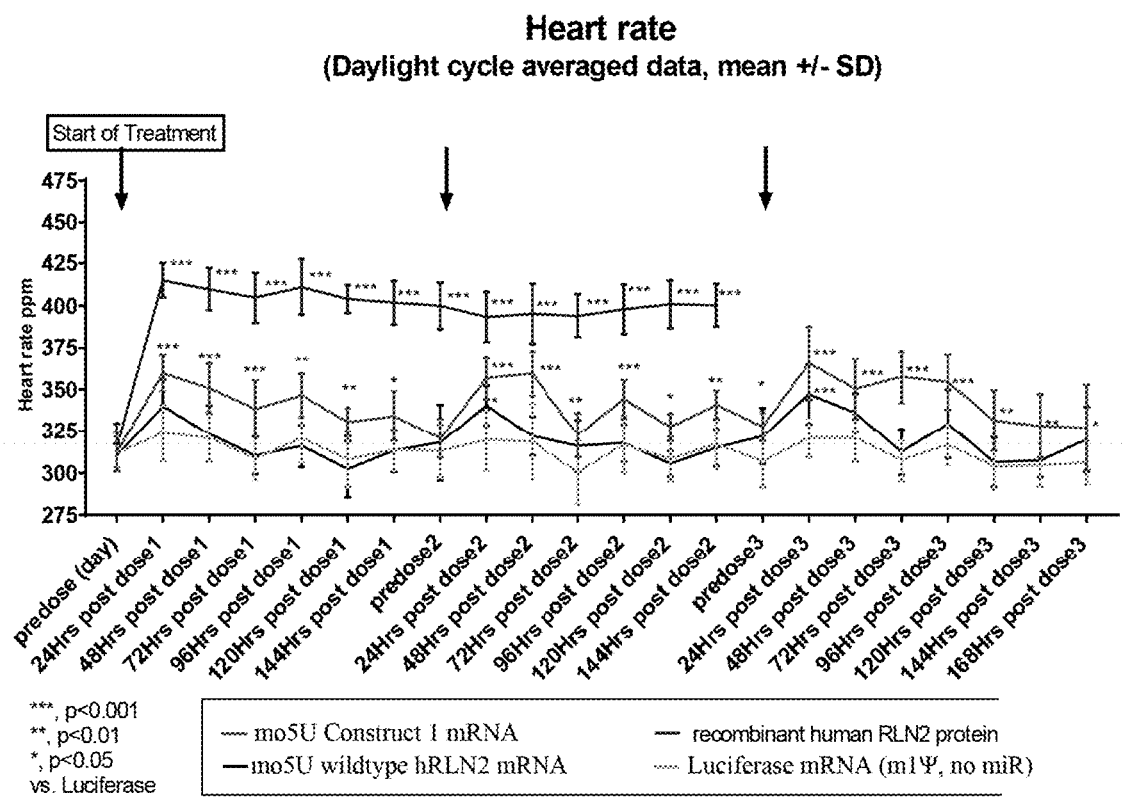
Figure 3B:
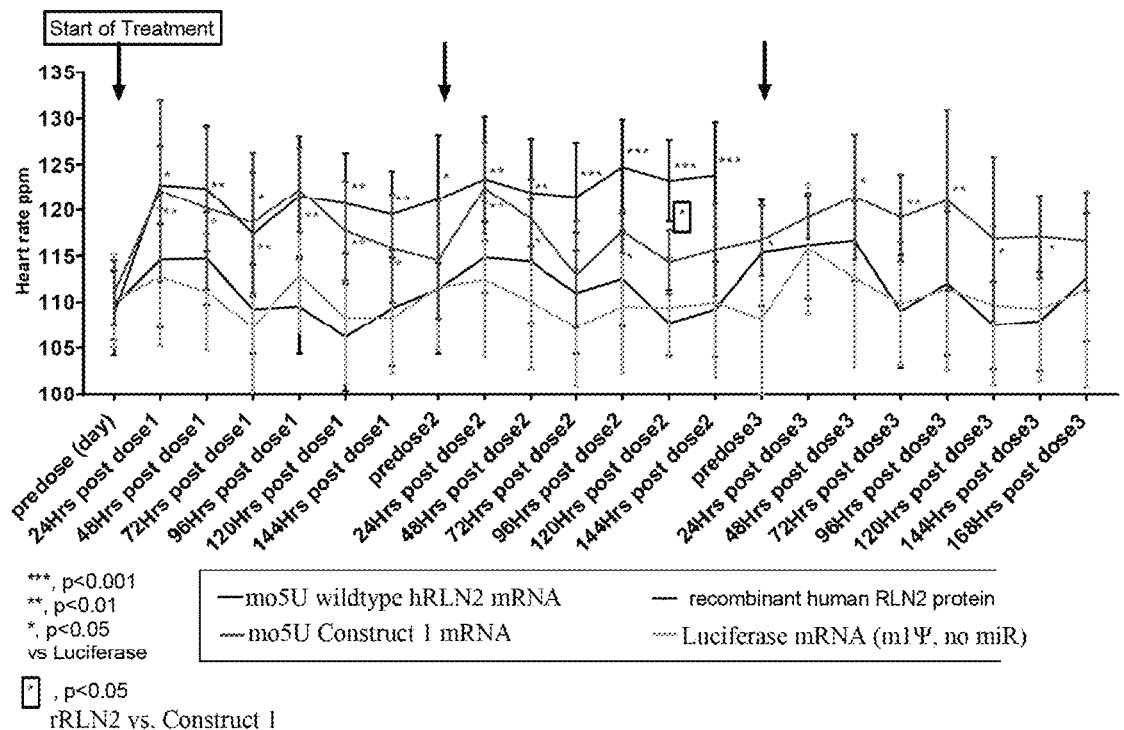

FIGS. 3A and 3B are graphs showing the VLk-RLN2 fusion protein mRNA produces a functional protein with sustained activity in IV-injected spontaneously hypertensive rats. FIG. 3A shows the heart rate of the rats and FIG. 3B shows the diastolic arterial pressure. The data are averaged per daytime and nighttime periods (means+/−SD) with periods of manipulation of the animals removed (N=8 rats per group).

FIG. 4 shows the circulating protein data in spontaneously hypertensive rats.

FIG. 5 shows that relaxin VLk-RLN2 fusion protein mRNA yields circulating protein levels above target concentrations in IV-injected cynomologus monkeys for up to six days.

FIG. 6 shows the results of an in vivo interpubic ligament elongation (ILE) assay, demonstrating that the VLk-RLN2 fusion protein mRNA produces a functional protein.

FIG. 7 shows in vivo screening for VLk-RLN2 fusion protein mRNA expression, demonstrating that circulating relaxin protein levels surpass target concentrations for up to six days in mRNA-injected rats.

FIG. 8 shows that VLk-RLN2 fusion protein mRNA expression relaxin concentrations exceed the target concentration for up to eight days in IV-injected mice.

FIG. 9 shows data from a re-dosing study in cynomolgus monkeys (see Example 14).

FIG. 10 shows data from a re-dosing study in cynomolgus monkeys (see Example 14).

FIG. 11 shows circulating mRNA levels of relaxin-VLk in cynomolgus monkeys after each administration (three doses).

FIG. 12 shows the interpubic ligament measurements of MC3-NTFIX, Compound 18-NTFIX, MC3-RLN2, Compound 18-RLN2 and rRLN2.

DETAILED DESCRIPTION

The present invention provides mRNA therapeutics for the treatment of fibrosis and/or cardiovascular disease. Both fibrosis and cardiovascular disease can result from a deficiency in circulating relaxin. mRNA therapeutics are particularly well-suited for the treatment of cardiovascular disease, fibrosis, and other disorders associated with relaxin deficiency, as the technology provides for the intracellular delivery of mRNA encoding relaxin followed by de novo synthesis of functional relaxin protein within target cells. After delivery of mRNA to the target cells, the desired relaxin protein is expressed by the cells' own translational machinery, and hence, fully functional relaxin protein replaces the defective or missing protein.

One challenge associated with delivering nucleic acid-based therapeutics (e.g., mRNA therapeutics) in vivo stems from the innate immune response which can occur when the body's immune system encounters foreign nucleic acids. Foreign mRNAs can activate the immune system via recognition through toll-like receptors (TLRs), in particular TLR7/8, which is activated by single-stranded RNA (ssRNA). In nonimmune cells, the recognition of foreign mRNA can occur through the retinoic acid-inducible gene I (RIG-I). Immune recognition of foreign mRNAs can result in unwanted cytokine effects including interleukin-1β (IL-1β) production, tumor necrosis factor-α (TNF-α) distribution and a strong type I interferon (type I IFN) response. The instant invention features the incorporation of different modified nucleotides within therapeutic mRNAs to minimize the immune activation and optimize the translation efficiency of mRNA to protein. Particular aspects of the invention feature a combination of nucleotide modification to reduce the innate immune response and sequence optimization, in particular, within the open reading frame (ORF) of therapeutic mRNAs encoding relaxin to enhance protein expression.

The mRNA therapeutic technology of the instant invention also features delivery of mRNA encoding relaxin via a lipid nanoparticle (LNP) delivery system. Lipid nanoparticles (LNPs) are an ideal platform for the safe and effective delivery of mRNAs to target cells. LNPs have the unique ability to deliver nucleic acids by a mechanism involving cellular uptake, intracellular transport and endosomal release or endosomal escape. The instant invention features novel ionizable lipid-based LNPs which have improved properties when administered in vivo. Without being bound in theory, it is believed that the novel ionizable lipid-based LNPs of the invention have improved properties, for example, cellular uptake, intracellular transport and/or endosomal release or endosomal escape. LNPs administered by systemic route (e.g., intravenous (IV) administration), for example, in a first administration, can accelerate the clearance of subsequently injected LNPs, for example, in further administrations. This phenomenon is known as accelerated blood clearance (ABC) and is a key challenge, in particular, when replacing deficient hormones (e.g., relaxin) in a therapeutic context. This is because repeat administration of mRNA therapeutics is in most instances essential to maintain necessary levels of enzyme in target tissues in subjects (e.g., subjects suffering from acute heart failure). Repeat dosing challenges can be addressed on multiple levels. mRNA engineering and/or efficient delivery by LNPs can result in increased levels and or enhanced duration of protein (e.g., relaxin) being expressed following a first dose of administration, which in turn, can lengthen the time between first dose and subsequent dosing. It is known that the ABC phenomenon is, at least in part, transient in nature, with the immune responses underlying ABC resolving after sufficient time following systemic administration. As such, increasing the duration of protein expression and/or activity following systemic delivery of an mRNA therapeutic of the invention in one aspect, combats the ABC phenomenon. Moreover, LNPs can be engineered to avoid immune sensing and/or recognition and can thus further avoid ABC upon subsequent or repeat dosing. Exemplary aspect of the invention feature novel LNPs which have been engineered to have reduced ABC.

Relaxin

Wild type relaxin is a 6000 Da heterodimeric polypeptide endocrine and autocrine/paracrine hormone, belonging to the insulin gene superfamily. It contains an A and a B chain joined by two interchain disulfide bonds, and one intra-A-chain disulfide bond. Relaxin facilitates angiogenesis and contributes to the repair of vascular endothelium. It exerts its effects on the musculoskeletal and other systems through binding its receptor in different tissues, a process mediated by different signaling pathways. There are seven known relaxin family peptides, including relaxin (RLN)1, RLN2, RLN3, and insulin-like peptide (INSL)3, INSL4, INSL5, INSL6. RLN1 and RLN2 are involved in collagen regulation and metabolism in fibroblasts, while RLN3 is specific to the brain. RLN1 and RLN2 are also involved in the hemodynamic changes that occur during pregnancy, including cardiac output, renal blood flow, and arterial compliance. Further, RLN2 mediates vasodilation through increased production of nitric oxide through a phosphorylation cascade. Relaxin is also a cardiac stimulant, and it can cause vasodilation through the inhibition of angiotensin II and endothelin, two potent vasoconstrictors. The hormone has also been shown to increase calcium sensitivity of cardiac myofilaments and increase phosphorylation of the myofilaments by protein kinase C. The force generated by the myofilaments increases while the energy consumption of the cardiac myocytes does not. In the kidneys, relaxin increases creatinine clearance and increases renal blood flow.

In humans, H2 relaxin (relaxin-2) is the major circulating form. The function of H2 relaxin is mediated mainly through the relaxin Family Peptide 1 (RXFP1) receptor, although it can also activate RXFP2 receptor with low potency. As used herein the term "relaxin" refers to a heterodimeric polypeptide capable of activating RXFP1 and/or RXFP2.

In some embodiments relaxin is a polypeptide having at least 70% sequence identity to SEQ ID NO. 1 or 3 or a fragment thereof or is encoded by a polynucleotide having at least 70% sequence identity to SEQ ID NOs. 2 or 4 or a fragment thereof. In other embodiments relaxin is a polypeptide having at least 75%, 80%, 85%, 90%, 95%, 97%, 98%, 99%, or 100% sequence identity to SEQ ID NOs. 1 or 3 or a fragment thereof or is encoded by a polynucleotide having at least 75%, 80%, 85%, 90%, 95%, 97%, 98%, 99%, or 100% sequence identity to SEQ ID NOs. 2 or 4 or a fragment thereof.

The invention in some aspects is an mRNA encoding a relaxin protein. Relaxin is a vasoactive peptide that protects the vascular system from overwork, increases renal function, promotes cell growth and survival, and maintains good vessel structure. The administration of relaxin to a subject has therapeutic benefits such as treating and preventing fibrosis e.g., renal fibrosis, cardiac fibrosis or pulmonary fibrosis and cardiovascular disease e.g., acute heart failure, coronary artery disease, microvascular disease, acute coronary syndrome with cardiac dysfunction, or ischemia reperfusion.

Although relaxin provides significant therapeutic benefits, recombinant wild type relaxin has a short half-life which makes the achievement of therapeutic levels in the body a challenge. A recombinant form of relaxin referred to as Serelaxin and marketed by Novartis, has been demonstrated to have low toxicity, however, the efficacy has been questionable because it is degraded so quickly in the bloodstream. Serelaxin has a half-life of about 15 minutes in serum and 7-8 hours during continuous 48 hour infusion.

In some aspects the invention is a therapeutic relaxin such as an mRNA encoding a wild type or stabilized relaxin protein, such as a relaxin-immunoglobulin fusion protein which has greatly enhanced half-life and thus may be more efficacious in the treatment of disease. In other aspects the therapeutic relaxin is a relaxin fusion protein. Additionally, the longer half-life of the stabilized relaxin therapeutics described herein may enable fewer patient doses with more time in between doses. Although PEGylated forms of relaxin have been demonstrated to be more stable than wild type relaxin, the increase in serum stability over Serelaxin appears to only be around 13.5%. The stable fusion proteins of the invention are significantly more stable. For instance, a fusion protein in which a VLk region is fused after the A chain of relaxin has an increased half-life in serum of 1-2 weeks relative to Serelaxin.

The ability to activate RXFP1 and/or RXFP2 refers to an increase in activation over the level of activation in the absence of a relaxin therapeutic. The ability to activate can be assessed, for instance, using an in vitro or in vivo assay, such as the assays described herein.

A relaxin fusion protein as used herein is protein comprised of relaxin linked to a stabilizing protein. In some embodiments the stabilizing protein is an immunoglobulin protein. In other embodiments the stabilizing protein is a VLk protein.

A relaxin nucleic acid or relaxin mRNA as used herein is an RNA encoding a wild type relaxin, variant thereof or fragment thereof (referred to as a wild type relaxin) or an RNA encoding a relaxin fusion protein i.e. relaxin linked to a stabilizing protein (referred to as a stabilized relaxin fusion protein). In some embodiments the stabilizing protein is an immunoglobulin protein. In other embodiments the stabilizing protein is a VLk protein.

The relaxin therapeutics of the invention are useful for treating a variety of disorders. For instance the relaxin therapeutics are useful for treating heart failure (acute or chronic) as well as acute dosing indications and chronic dosing indications. Acute dosing indications include but are not limited to acute heart failure (non-ischemic), acute coronary syndrome with cardiac dysfunction, ischemia reperfusion associated with solid organ transplantation, such as lung, kidney, liver, heart, Cardiopulmonary bypass organ protection e.g., renal, and corneal healing i.e., by ocular administration. Chronic dosing indications include but are not limited to chronic heart failure, diabetic nephropathy, NASH, atrial fibrillation, cardiac fibrosis, diabetic wound healing and cirrhosis.

Heart failure (HF) involves the inability of the left ventricle to fill with or eject blood, reducing the capacity to deliver oxygenated blood to the rest of the body. It is a more common, more costly, and more deadly than cancer. Heart failure is a complex disease with a number of underlying causes and various co-morbidities. Some of the major causes of HF include: coronary artery disease, heart attack, high blood pressure, abnormal heart valve(s), cardiomyopathy, myocarditis, congenital heart defect(s), diabetes, obesity, lung disease, and sleep apnea. In response to heart failure, the body attempts to adapt and deliver the necessary blood, which can result in heart enlargement, increased cardiac muscle mass, increased heart rate, blood vessel narrowing, and the diversion of blood away from other organs. Treatment decisions are typically made on a patient-by-patient basis due to the heterogeneity of the disease.

There are two types of HF: acute (approximately 10% of HF cases), which develops rapidly and requires hospitalization, and chronic (approximately 90% of HF cases), which develops gradually and requires long term treatment. Among the two types, there are four classes of heart failure: class I (asymptomatic, 40% of HF patients), class II (HF symptoms with moderate exertion, 30% of HF patients), class III (HF symptoms with minimal exertion, 20% of HF patients), and class IV (HF symptoms at rest, 10% of HF patients). The mortality of subjects with heart failure is as follows: in-hospital (6%), 30-day post-discharge (11%), one-year (30%), and five-year (50%).

Heart failure can be graded quantified using ejection fraction (EF), a measure of how well the heart pumps blood to the body. EF compares the amount of blood in the heart to the amount of blood pumped out. It is calculated as the amount of blood pumped out divided by the amount of blood in the chamber.

In some embodiments, relaxin mRNA of the present disclosure is used to treat actuate HF for both inpatient and follow-up dosing. In further embodiments, relaxin mRNA is used to relieve HF symptoms, prevent disease progression and mortality, and/or decrease HF hospitalization. In other embodiments the relaxin mRNA of the present disclosure is used to treat diseases such as acute coronary syndrome with cardiac dysfunction, ischemia reperfusion associated with solid organ transplantation (for example lung, kidney, liver, and/or heart), cardiopulmonary bypass (for example, to protect renal function), corneal healing, diabetic nephropathy, nonalcoholic steatohepatitis (NASH), atrial fibrillation (cardiac fibrosis), diabetic wound healing, and cirrhosis.

The skilled artisan will appreciate that the therapeutic effectiveness of a drug or a treatment of the instant invention can be characterized or determined by measuring the level of expression of an encoded protein in a sample or in samples taken from a subject (e.g., from a preclinical test subject (rodent, primate, etc.) or from a clinical subject (human). Likewise, the therapeutic effectiveness of a drug or a treatment of the instant invention can be characterized or determined by measuring the level of activity of an encoded protein in a sample or in samples taken from a subject (e.g., from a preclinical test subject (rodent, primate, etc.) or from a clinical subject (human). Furthermore, the therapeutic effectiveness of a drug or a treatment of the instant invention can be characterized or determined by measuring the level of an appropriate biomarker in sample(s) taken from a subject. Levels of protein and/or biomarkers can be determined post-administration with a single dose of an mRNA therapeutic of the invention or can be determined and/or monitored at several time points following administration with a single dose or can be determined and/or monitored throughout a course of treatment, e.g., a multi-dose treatment.

Relaxin Protein Expression Levels

Certain aspects of the invention feature measurement, determination and/or monitoring of the expression level or levels of relaxin protein in a subject, for example, in an animal (e.g., rodents, primates, and the like) or in a human subject. Animals include normal, healthy or wildtype animals, as well as animal models for use in understanding cardiovascular disease and treatments thereof. Exemplary animal models include rodent models, for example, relaxin deficient mice also referred to as cardiovascular disease mice. Relaxin protein expression levels can be measured or determined by any art-recognized method for determining protein levels in biological samples, e.g., serum or plasma sample. The term "level" or "level of a protein" as used herein, preferably means the weight, mass or concentration of the protein within a sample or a subject. It will be understood by the skilled artisan that in certain embodiments the sample may be subjected, e.g., to any of the following: purification, precipitation, separation, e.g. centrifugation and/or HPLC, and subsequently subjected to determining the level of the protein, e.g., using mass and/or spectrometric analysis. In exemplary embodiments, enzyme-linked immunosorbent assay (ELISA) can be used to determine protein expression levels. In other exemplary embodiments, protein purification, separation and LC-MS can be used as a means for determining the level of a protein according to the invention. In some embodiments, an mRNA therapy of the invention (e.g., a single intravenous dose) results in increased relaxin protein expression levels in the plasma or serum of the subject (e.g., 2-fold, 3-fold, 4-fold, 5-fold, 6-fold, 7-fold, 8-fold, 9-fold, or 10-fold increase and/or increased to at least 50%, at least 60%, at least 70%, at least 75%, 80%, at least 85%, at least 90%, at least 95%, or at least 100% normal levels) for at least 6 hours, at least 12 hours, at least 24 hours, at least 36 hours, at least 48 hours, at least 60 hours, at least 72 hours, at least 84 hours, at least 96 hours, at least 108 hours, at least 122 hours after administration of a single dose of the mRNA therapy.

Relaxin Protein Activity

In cardiovascular disease patients, relaxin activity is reduced, e.g., to about 25%, 30%, 40% or 50% of normal. Further aspects of the invention feature measurement, determination and/or monitoring of the activity level(s) of relaxin protein in a subject, for example, in an animal (e.g., rodent, primate, and the like) or in a human subject. Activity levels can be measured or determined by any art-recognized method for determining activity levels in biological samples. The term "activity level" as used herein, preferably means the activity of the protein per volume, mass or weight of sample or total protein within a sample.

In exemplary embodiments, an mRNA therapy of the invention features a pharmaceutical composition comprising a dose of mRNA effective to result in at least 5 U/mg, at least 10 U/mg, at least 20 U/mg, at least 30 U/mg, at least 40 U/mg, at least 50 U/mg, at least 60 U/mg, at least 70 U/mg, at least 80 U/mg, at least 90 U/mg, at least 100 U/mg, or at least 150 U/mg of relaxin activity in tissue (e.g., plasma) between 6 and 12 hours, or between 12 and 24, between 24 and 48, or between 48 and 72 hours post administration (e.g., at 48 or at 72 hours post administration). In exemplary embodiments, an mRNA therapy of the invention features a pharmaceutical composition comprising a dose of mRNA effective to result in at least 50 U/mg, at least 100 U/mg, at least 200 U/mg, at least 300 U/mg, at least 400 U/mg, at least 500 U/mg, at least 600 U/mg, at least 700 U/mg, at least 800 U/mg, at least 900 U/mg, at least 1,000 U/mg, or at least 1,500 U/mg of relaxin activity in plasma between 6 and 12 hours, or between 12 and 24, between 24 and 48, or between 48 and 72 hours post administration (e.g., at 48 or at 72 hours post administration).

In exemplary embodiments, an mRNA therapy of the invention features a pharmaceutical composition comprising a single intravenous dose of mRNA that results in the above-described levels of activity. In another embodiment, an mRNA therapy of the invention features a pharmaceutical composition which can be administered in multiple single unit intravenous doses of mRNA that maintain the above-described levels of activity.

Relaxin Biomarkers

Further aspects of the invention feature determining the level (or levels) of a biomarker, e.g., B-type natriuretic peptide (BNP), Cystatin C, N-terminal prohormone of BNP (NT-proBNP), determined in a sample as compared to a level (e.g., a reference level) of the same or another biomarker in another sample, e.g., from the same patient, from another patient, from a control and/or from the same or different time points, and/or a physiologic level, and/or an elevated level, and/or a supraphysiologic level, and/or a level of a control. The skilled artisan will be familiar with physiologic levels of biomarkers, for example, levels in normal or wildtype animals, normal or healthy subjects, and the like, in particular, the level or levels characteristic of subjects who are healthy and/or normal functioning. As used herein, the phrase "elevated level" means amounts greater than normally found in a normal or wildtype preclinical animal or in a normal or healthy subject, e.g. a human subject. As used herein, the term "supraphysiologic" means amounts greater than normally found in a normal or wild-type preclinical animal or in a normal or healthy subject, e.g. a human subject, optionally producing a significantly enhanced physiologic response. As used herein, the term "comparing" or "compared to" preferably means the mathematical comparison of the two or more values, e.g., of the levels of the biomarker(s). It will thus be readily apparent to the skilled artisan whether one of the values is higher, lower or identical to another value or group of values if at least two of such values are compared with each other. Comparing or comparison to can be in the context, for example, of comparing to a control value, e.g., as compared to a reference serum NT-proBNP, a reference serum Cystatin C and/or a reference serum BNP level in said subject prior to administration (e.g., in a person suffering from cardiovascular disease) or in a normal or healthy subject. Comparing or comparison to can also be in the context, for example, of comparing to a control value, e.g., as compared to a reference urinary NT-proBNP excretion level or serum BNP, Cystatin C, NT-proBNP level in said subject prior to administration (e.g., in a person suffering from cardiovascular disease) or in a normal or healthy subject.

As used herein, a "control" is preferably a sample from a subject wherein the cardiovascular disease status of said subject is known. In one embodiment, a control is a sample of a healthy patient. In another embodiment, the control is a sample from at least one subject having a known cardiovascular disease status, for example, a severe, mild, or healthy cardiovascular disease status, e.g. a control patient. In another embodiment, the control is a sample from a subject not being treated for cardiovascular disease. In a still further embodiment, the control is a sample from a single subject or a pool of samples from different subjects and/or samples taken from the subject(s) at different time points.

The term "level" or "level of a biomarker" as used herein, preferably means the mass, weight or concentration of a biomarker of the invention within a sample or a subject. Biomarkers of the invention include, for example, BNP, Cystatin C, NT-proBNP. It will be understood by the skilled artisan that in certain embodiments the sample may be subjected to, e.g., one or more of the following: substance purification, precipitation, separation, e.g. centrifugation and/or HPLC and subsequently subjected to determining the level of the biomarker, e.g. using mass spectrometric analysis. In exemplary embodiments, LC-MS can be used as a means for determining the level of a biomarker according to the invention.

The term "determining the level" of a biomarker as used herein can mean methods which include quantifying an amount of at least one substance in a sample from a subject, for example, in a bodily fluid from the subject (e.g., serum, plasma, urine, blood, lymph, fecal, etc.) or in a tissue of the subject (e.g., liver, heart, spleen kidney, etc.).

The term "reference level" as used herein can refer to levels (e.g., of a biomarker) in a subject prior to administration of an mRNA therapy of the invention (e.g., in a person suffering from cardiovascular disease) or in a normal or healthy subject.

As used herein, the term "normal subject" or "healthy subject" refers to a subject not suffering from symptoms associated with cardiovascular disease. Moreover, a subject will be considered to be normal (or healthy) if it has no mutation of the functional portions or domains of the relaxin name (relaxin) gene and/or no mutation of the relaxin gene resulting in a reduction of or deficiency of the relaxin or the activity thereof, resulting in symptoms associated with cardiovascular disease. Said mutations will be detected if a sample from the subject is subjected to a genetic testing for such relaxin mutations. In exemplary embodiments of the present invention, a sample from a healthy subject is used as a control sample, or the known or standardized value for the level of biomarker from samples of healthy or normal subjects is used as a control.

In some embodiments, comparing the level of the biomarker in a sample from a subject in need of treatment for cardiovascular disease or in a subject being treated for cardiovascular disease to a control level of the biomarker comprises comparing the level of the biomarker in the sample from the subject (in need of treatment or being treated for cardiovascular disease) to a baseline or reference level, wherein if a level of the biomarker in the sample from the subject (in need of treatment or being treated for cardiovascular disease) is elevated, increased or higher compared to the baseline or reference level, this is indicative that the subject is suffering from cardiovascular disease and/or is in need of treatment; and/or wherein if a level of the biomarker in the sample from the subject (in need of treatment or being treated for cardiovascular disease) is decreased or lower compared to the baseline level this is indicative that the subject is not suffering from, is successfully being treated for cardiovascular disease, or is not in need of treatment for cardiovascular disease. The stronger the reduction (e.g., at least 2-fold, at least 3-fold, at least 4-fold, at least 5-fold, at least 6-fold, at least 7-fold, at least 8-fold, at least 10-fold reduction and/or at least 10%, at least 20%, at least 30% at least 40%, at least 50%, at least 60%, at least 70%, at least 80%, at least 90%, or at least 100% reduction) of the level of a biomarker, e.g., BNP, Cystatin C, NT-proBNP, within a certain time period, e.g., within 6 hours, within 12 hours, 24 hours, 36 hours, 48 hours, 60 hours, or 72 hours, and/or for a certain duration of time, e.g., 48 hours, 72 hours, 96 hours, 120 hours, 144 hours, 1 week, 2 weeks, 3 weeks, 4 weeks, 1 month, 2 months, 3 months, 4 months, 5 months, 6 months, 7 months, 8 months, 9 months, 10 months, 11 months, 12 months, 18 months, 24 months, etc. the more successful is a therapy, such as for example an mRNA therapy of the invention (e.g., a single dose or a multiple regimen).

A reduction of at least about 20%, at least about 30%, at least about 40%, at least about 50%, at least about 60%, at least about 70%, at least about 80%, at least about 90%, at least 100% or more of the level of biomarker, in particular, in bodily fluid (e.g., plasma, urine, e.g., urinary sediment) or in tissue(s) in a subject (e.g., liver, heart, spleen, kidney, brain or lung), for example a BNP, Cystatin C, NT-proBNP, within 1, 2, 3, 4, 5, 6 or more days following administration is indicative of a dose suitable for successful treatment cardiovascular disease, wherein reduction as used herein, preferably means that the level of biomarker determined at the end of a specified time period (e.g., post-administration, for example, of a single intravenous dose) is compared to the level of the same biomarker determined at the beginning of said time period (e.g., pre-administration of said dose). Exemplary time periods include 12, 24, 48, 72, 96, 120 or 144 hours post administration, in particular 24, 48, 72 or 96 hours post administration.

A sustained reduction in substrate levels (e.g., BNP, Cystatin C, NT-proBNP) is particularly indicative of mRNA therapeutic dosing and/or administration regimens successful for treatment of cardiovascular disease. Such sustained reduction can be referred to herein as "duration" of effect. In exemplary embodiments, a reduction of at least about 40%, at least about 50%, at least about 60%, at least about 65%, at least about 70%, at least about 75%, at least about 80%, at least about 85%, at least about 90%, or at least about 95% or more of the level of biomarker, in particular, in a bodily fluid (e.g., plasma, urine, e.g., urinary sediment) or in tissue(s) in a subject (e.g., liver, heart, spleen, kidney, brain or lung), for example BNP, Cystatin C, NT-proBNP, within 4, 5, 6, 7, 8 or more days following administration is indicative of a successful therapeutic approach. In exemplary embodiments, sustained reduction in substrate (e.g., biomarker) levels in one or more samples (e.g., fluids and/or tissues) is preferred. For example, mRNA therapies resulting in sustained reduction in BNP, Cystatin C, NT-proBNP (as defined herein), optionally in combination with sustained reduction of said biomarker in at least one tissue, preferably two, three, four, five or more tissues, is indicative of successful treatment.

In some embodiments, a single dose of an mRNA therapy of the invention is about 0.2 to about 0.8 mpk. about 0.3 to about 0.7 mpk, about 0.4 to about 0.8 mpk, or about 0.5 mpk. In another embodiment, a single dose of an mRNA therapy of the invention is less than 1.5 mpk, less than 1.25 mpk, less than 1 mpk, or less than 0.75 mpk.

The RNA polynucleotides useful in the invention include RNA encoding for one or more relaxin proteins.

In some embodiments the RNA polynucleotide formulated in a ionizable lipid nanoparticle has a therapeutic index of greater than 10% of the therapeutic index of the RNA polynucleotide alone. In other embodiments the RNA polynucleotide formulated in the ionizable lipid nanoparticle has a therapeutic index of greater than 20%, 30%, 40%, 50%, 60%, 70%, 80%, or 90% of the therapeutic index of the RNA polynucleotide alone. The therapeutic index (TI) (also referred to as therapeutic ratio) is a comparison of the amount of a therapeutic agent that causes the therapeutic effect to the amount that causes toxicity.

The invention involves methods for increasing stability or circulation time of relaxin proteins. In some embodiments the composition has a circulating half-life of greater than 20 minutes. In some embodiments the composition has a circulating half-life of 20-500 minutes, 30-500 minutes, 50-500 minutes, 30-300 minutes, 30-200 minutes, 30-100 minutes, 50-500 minutes, 50-400 minutes, 50-300 minutes, 50-200 minutes, 50-100 minutes, 100-500 minutes, 100-400 minutes, 100-300 minutes, 100-200 minutes, or 100-150 minutes. In other embodiments the relaxin fusion protein has at least a 25%, 30%, 35%, 40%, 45%, 50%, 55%, 60%, 65%, 70%, 75%, 80%, 85%, 90, 95%, or 99% increase in circulating half-life relative to wild type relaxin circulating half-life levels.

Another advantage of the methods of the invention is that the relaxin protein level increase is achieved rapidly following dosing of the subject. For instance therapeutic or maximal therapeutic levels may be achieved within 1, 2, 3, or 4 hours of dosing the subject. The term Cmax refers to the maximum (or peak) serum concentration that a drug achieves in a specified compartment or test area of the body after the drug has been administrated and before the administration of a second dose. Tmax refers to the time after administration of a drug when the maximum plasma concentration is reached; when the rate of absorption equals the rate of elimination.

The sequences of isoforms 1 and 2 for wild type relaxin are described at the NCBI Reference Sequence database (RefSeq) under accession numbers NM_134441.2 and NM_005059.3, respectfully ("*Homo sapiens* relaxin 2 (RLN2), transcript variant 1" (SEQ ID NO: 325) and "*Homo sapiens* relaxin 2 (RLN2), transcript variant 2" (SEQ ID NO:

326)). The wild type relaxin canonical protein sequence is described at the RefSeq database under accession number AAI26416.1 ("relaxin 2 [*Homo sapiens*]") (SEQ ID NO. 1).

In certain aspects, the invention provides a polynucleotide (e.g., a ribonucleic acid (RNA), e.g., a messenger RNA (mRNA)) comprising a nucleotide sequence (e.g., an open reading frame (ORF)) encoding a relaxin polypeptide. In some embodiments, the relaxin polypeptide of the invention is a wild type relaxin or variant relaxin protein. In some embodiments, the relaxin polypeptide of the invention is a variant, a peptide or a polypeptide containing a substitution, and insertion and/or an addition, a deletion and/or a covalent modification with respect to a wild-type relaxin protein sequence. In some embodiments, sequence tags or amino acids, can be added to the sequences encoded by the polynucleotides of the invention (e.g., at the N-terminal or C-terminal ends), e.g., for localization. In some embodiments, amino acid residues located at the carboxy, amino terminal, or internal regions of a polypeptide of the invention can optionally be deleted providing for fragments.

In some embodiments, the polynucleotide (e.g., a RNA, e.g., an mRNA) comprising a nucleotide sequence (e.g., an ORF) of the invention encodes a substitutional variant of a wild type relaxin protein sequence, which can comprise one, two, three or more than three substitutions. In some embodiments, the substitutional variant can comprise one or more conservative amino acids substitutions. In other embodiments, the variant is an insertional variant. In other embodiments, the variant is a deletional variant.

As recognized by those skilled in the art, wild type or variant relaxin protein fragments, functional protein domains, variants, and homologous proteins (orthologs) are also considered to be within the scope of the relaxin polypeptides of the invention.

Certain compositions and methods presented in this disclosure refer to the protein or polynucleotide sequences of wild type or variant relaxin protein. A person skilled in the art will understand that such disclosures are equally applicable to any other isoforms of relaxin proteins known in the art.

Polynucleotides and Open Reading Frames (ORFs)

In certain aspects, the invention provides polynucleotides (e.g., a RNA, e.g., an mRNA) that comprise a nucleotide sequence (e.g., an ORF) encoding one or more relaxin polypeptides. In some embodiments, the encoded therapeutic polypeptide of the invention can be selected from:

a full length relaxin polypeptide (e.g., having the same or essentially the same length as the wild type relaxin polypeptide);

a variant such as a functional fragment of any of wild type relaxin proteins described herein (e.g., a truncated (e.g., deletion of carboxy, amino terminal, or internal regions) sequence shorter than one of wild type relaxin proteins; but still retaining the functional activity of the protein);

a variant such as a full length or truncated wild type relaxin proteins in which one or more amino acids have been replaced, e.g., variants that retain all or most of the relaxin activity of the polypeptide with respect to a reference isoform (e.g., any natural or artificial variant known in the art); or a fusion protein comprising (i) a full length wild type relaxin protein, variant relaxin protein, a functional fragment or a variant thereof, and (ii) a heterologous protein.

In certain embodiments, the encoded relaxin polypeptide is a mammalian relaxin polypeptide, such as a human relaxin polypeptide, a functional fragment or a variant thereof.

In some embodiments, the polynucleotide (e.g., a RNA, e.g., an mRNA) of the invention increases relaxin protein expression levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to relaxin protein expression levels in the cells prior to the administration of the polynucleotide of the invention. relaxin protein expression levels can be measured according to methods know in the art. In some embodiments, the polynucleotide is introduced to the cells in vitro. In some embodiments, the polynucleotide is introduced to the cells in vivo.

In some embodiments, the polynucleotide (e.g., a RNA, e.g., an mRNA) of the invention comprises a codon optimized nucleic acid sequence, wherein the open reading frame (ORF) of the codon optimized nucleic sequence is derived from a relaxin protein sequence. For example, for polynucleotides of invention comprising a sequence optimized ORF encoding a specific relaxin protein, the corresponding wild type sequence is the native relaxin protein. Similarly, for a sequence optimized mRNA encoding a functional fragment of a relaxin protein, the corresponding wild type sequence is the corresponding fragment from the wild-type relaxin protein.

In some embodiments, the polynucleotides (e.g., a RNA, e.g., an mRNA) of the invention comprise a nucleotide sequence encoding wild type relaxin protein having the full length sequence of wild type human relaxin protein (i.e., including the initiator methionine). In mature wild type relaxin protein, the initiator methionine can be removed to yield a "mature relaxin protein" comprising amino acid residues of 2 to the remaining amino acids of the translated product. The teachings of the present disclosure directed to the full sequence of human relaxin protein are also applicable to the mature form of human relaxin protein lacking the initiator methionine. Thus, in some embodiments, the polynucleotides (e.g., a RNA, e.g., an mRNA) of the invention comprise a nucleotide sequence encoding wild type relaxin protein having the mature sequence of wild type human relaxin protein (i.e., lacking the initiator methionine). In some embodiments, the polynucleotide (e.g., a RNA, e.g., an mRNA) of the invention comprising a nucleotide sequence encoding wild type relaxin protein having the full length or mature sequence of human wild type relaxin protein is sequence optimized.

In some embodiments, the polynucleotides (e.g., a RNA, e.g., an mRNA) of the invention comprise a nucleotide sequence (e.g., an ORF) encoding a mutant relaxin polypeptide. In some embodiments, the polynucleotides of the invention comprise an ORF encoding a relaxin polypeptide that comprises at least one point mutation in the relaxin protein sequence and retains relaxin protein activity. In some embodiments, the mutant relaxin polypeptide has a relaxin activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the relaxin activity of the corresponding wild-type relaxin protein (i.e., the same wild type relaxin protein but without the mutation(s)). In some embodiments, the polynucleotide (e.g., a RNA, e.g., an mRNA) of the invention comprising an ORF encoding a mutant relaxin polypeptide is sequence optimized.

In some embodiments, the polynucleotide (e.g., a RNA, e.g., an mRNA) of the invention comprises a nucleotide sequence (e.g., an ORF) that encodes a relaxin polypeptide with mutations that do not alter relaxin protein activity. Such mutant relaxin polypeptides can be referred to as function-neutral. In some embodiments, the polynucleotide comprises an ORF that encodes a mutant relaxin polypeptide comprising one or more function-neutral point mutations.

In some embodiments, the mutant relaxin polypeptide has higher relaxin protein activity than the corresponding wild-type relaxin protein. In some embodiments, the mutant relaxin polypeptide has a relaxin activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type relaxin protein (i.e., the same wild type relaxin protein but without the mutation(s)).

In some embodiments, the polynucleotides (e.g., a RNA, e.g., an mRNA) of the invention comprise a nucleotide sequence (e.g., an ORF) encoding a functional relaxin protein fragment, e.g., where one or more fragments correspond to a polypeptide subsequence of a wild type relaxin polypeptide and retain relaxin protein activity. In some embodiments, the relaxin protein fragment has activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the relaxin protein activity of the corresponding full length relaxin protein. In some embodiments, the polynucleotides (e.g., a RNA, e.g., an mRNA) of the invention comprising an ORF encoding a functional relaxin protein fragment is sequence optimized.

In some embodiments, the polynucleotide (e.g., a RNA, e.g., an mRNA) of the invention comprises a nucleotide sequence (e.g., an ORF) encoding a relaxin protein fragment that has higher relaxin protein activity than the corresponding full length relaxin protein. Thus, in some embodiments the relaxin protein fragment has relaxin activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the relaxin activity of the corresponding full length relaxin protein.

In some embodiments, the polynucleotide (e.g., a RNA, e.g., an mRNA) of the invention comprises a nucleotide sequence (e.g., an ORF) encoding a relaxin protein fragment that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% shorter than wild-type relaxin protein.

In some embodiments, the polynucleotide (e.g., a RNA, e.g., an mRNA) of the invention comprises from about 1,200 to about 100,000 nucleotides (e.g., from 1,200 to 1,500, from 1,200 to 1,600, from 1,200 to 1,700, from 1,200 to 1,800, from 1,200 to 1,900, from 1,200 to 2,000, from 1,300 to 1,500, from 1,300 to 1,600, from 1,300 to 1,700, from 1,300 to 1,800, from 1,300 to 1,900, from 1,300 to 2,000, from 1,425 to 1,500, from 1,425 to 1,600, from 1,425 to 1,700, from 1,425 to 1,800, from 1,425 to 1,900, from 1,425 to 2,000, from 1,425 to 3,000, from 1,425 to 5,000, from 1,425 to 7,000, from 1,425 to 10,000, from 1,425 to 25,000, from 1,425 to 50,000, from 1,425 to 70,000, or from 1,425 to 100,000).

In some embodiments, the polynucleotide of the invention (e.g., a RNA, e.g., an mRNA) comprises a nucleotide sequence (e.g., an ORF) encoding a relaxin polypeptide (e.g., the wild-type sequence, functional fragment, or variant thereof), wherein the length of the nucleotide sequence (e.g., an ORF) is at least 500 nucleotides in length (e.g., at least or greater than about 500, 600, 700, 80, 900, 1,000, 1,100, 1,200, 1,300, 1,400, 1,425, 1450, 1,500, 1,600, 1,700, 1,800, 1,900, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the polynucleotide of the invention (e.g., a RNA, e.g., an mRNA) comprises a nucleotide sequence (e.g., an ORF) encoding a relaxin polypeptide (e.g., the wild-type sequence, functional fragment, or variant thereof) further comprises at least one nucleic acid sequence that is noncoding, e.g., a miRNA binding site.

In some embodiments, the polynucleotide of the invention comprising a nucleotide sequence (e.g., an ORF) encoding a relaxin polypeptide (e.g., the wild-type sequence, functional fragment, or variant thereof) is RNA. In some embodiments, the polynucleotide of the invention is, or functions as, a messenger RNA (mRNA). In some embodiments, the mRNA comprises a nucleotide sequence (e.g., an ORF) that encodes at least one relaxin polypeptide, and is capable of being translated to produce the encoded relaxin polypeptide in vitro, in vivo, in situ or ex vivo.

In some embodiments, the polynucleotide of the invention (e.g., a RNA, e.g., an mRNA) comprises a sequence-optimized nucleotide sequence (e.g., an ORF) encoding a relaxin polypeptide (e.g., the wild-type sequence, functional fragment, or variant thereof), wherein the polynucleotide comprises at least one chemically modified nucleobase, e.g., 5-methoxyuracil. In some embodiments, the polynucleotide further comprises a miRNA binding site, e.g., a miRNA binding site that binds to miR-142. In some embodiments, the polynucleotide disclosed herein is formulated with a delivery agent, e.g., a ionizable lipid nanoparticle comprising, for instance, a lipid having Formula (I), (IA), (II), (IIa), (IIb), (IIc), (IId) or (IIe), e.g., any of Compounds 1-232.

Signal Sequences

The polynucleotides (e.g., a RNA, e.g., an mRNA) of the invention can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the polynucleotide (e.g., a RNA, e.g., an mRNA) comprises a nucleotide sequence (e.g., an ORF) that encodes a signal peptide operably linked a nucleotide sequence that encodes a relaxin polypeptide described herein.

In some embodiments, the "signal sequence" or "signal peptide" is a polynucleotide or polypeptide, respectively, which is from about 9 to 200 nucleotides (3-70 amino acids) in length that, optionally, is incorporated at the 5' (or N-terminus) of the coding region or the polypeptide, respectively. Addition of these sequences results in trafficking the encoded polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the polynucleotide of the invention comprises a nucleotide sequence encoding a wild type relaxin polypeptide, wherein the nucleotide sequence further comprises a 5' nucleic acid sequence encoding a native signal peptide. In another embodiment, the polynucleotide of the invention comprises a nucleotide sequence encoding a wild type relaxin polypeptide, wherein the nucleotide sequence lacks the nucleic acid sequence encoding a native signal peptide.

In some embodiments, the polynucleotide of the invention comprises a nucleotide sequence encoding a relaxin polypeptide, wherein the nucleotide sequence further comprises a 5' nucleic acid sequence encoding a heterologous signal peptide.

Fusion Proteins

In some embodiments, the relaxin therapeutic is a polypeptide or polynucleotide (e.g., a RNA, e.g., an mRNA) that comprises more than one nucleic acid sequence (e.g., an ORF) encoding a polypeptide of interest. In some embodiments, polynucleotides of the invention comprise a single ORF encoding a relaxin polypeptide, a functional fragment, or a variant thereof. However, in some embodiments, the polynucleotide of the invention can comprise more than one ORF, for example, a first ORF encoding a relaxin polypeptide (a first polypeptide of interest), a functional fragment, or a variant thereof, and a second ORF expressing a second polypeptide such as a stabilizing sequence. In some embodiments, two or more polypeptides of interest can be genetically fused, i.e., two or more polypeptides can be encoded by the same ORF. In some embodiments, the polynucleotide can comprise a nucleic acid sequence encoding a linker (e.g., a $G_4S$ peptide linker (SEQ ID NO: 588) or another linker known in the art) between two or more polypeptides of interest.

In some embodiments, a polynucleotide of the invention (e.g., a RNA, e.g., an mRNA) can comprise two, three, four, or more ORFs, each expressing a polypeptide.

In some embodiments, the polynucleotide of the invention (e.g., a RNA, e.g., an mRNA) can comprise a first nucleic acid sequence (e.g., a first ORF) encoding a relaxin polypeptide and a second nucleic acid sequence (e.g., a second ORF) encoding a second polypeptide such as a stabilizing sequence.

A stabilizing sequence, as used herein, is a peptide sequence which confers stability on a fused protein. The stabilizing sequence may in some embodiments be an immunoglobulin (Ig) or fragment thereof. Immunoglobulins include four IgG subclasses (IgG1, 2, 3, and 4) in humans, named in order of their abundance in serum. The IgG isotype, is composed of two light chains and two heavy chains, where each heavy chain contains three constant heavy domains ($C_{H1}$, $C_{H2}$, $C_{H3}$). The two heavy chains of IgG are linked to each other and to a light chain each by disulfide bonds. The antigen binding site of IgG is located in the Fragment antigen binding region (Fab region), which contains variable light ($V_L$) and variable heavy ($V_H$) chain domains as well as constant light ($C_L$) and constant heavy ($C_{H1}$) chain domains. The fragment crystallizable region (Fc region) of IgG is a portion of the heavy chain containing the $C_{H2}$ and $C_{H3}$ domains that binds to an Fc receptor found on the surface of certain cells, including the neonatal Fc receptor (FcRn). The heavy chain of IgG also has a hinge region (hinge) between the $C_{H1}$ and $C_{H2}$ domains that separates the Fab region from the Fc region and participates in linking the two heavy chains together via disulfide bonds.

In some embodiments the Ig fragment is a portion of a constant heavy region ($C_H$) or variable heavy region ($V_H$) derived from an Ig molecule. The Ig fragment can include any portion of the constant or variable heavy region, including one or more constant or variable heavy domains, a hinge region, an Fc region, and/or combinations thereof.

In some embodiments the Ig fragment is a portion of a constant light region ($C_L$) or variable light region ($V_L$) derived from an Ig molecule. The Ig fragment can include any portion of the constant or variable light region, including one or more constant or variable light domains, a hinge region, an Fc region, and/or combinations thereof.

In certain embodiments, the Ig fragment of the fusion protein comprises a single chain Fc (sFc or scFc), a monomer, that is incapable of forming a dimer. In some embodiments, the fusion protein includes a sequence corresponding to an immunoglobulin hinge region. In various embodiments, the hinge region contains a modification that prevents the fusion protein from forming a disulfide bond with another fusion protein or another immunoglobulin molecule. In some embodiments, the hinge region is modified by mutating and/or deleting one or more cysteine amino acids to prevent the formation of a disulfide bond.

In some embodiments the Ig fragment is a kappa light chain variable region (VLk) sequence.

The fusion protein may have the relaxin linked to the N-terminus of the Ig fragment. Alternatively, the fusion protein may have the relaxin linked to the C-terminus of the Ig fragment. In specific embodiments, the fusion protein comprises the relaxin at its N-terminus that is linked to a VLk. In other embodiments, the fusion protein comprises the relaxin at its C-terminus that is linked to a VLk.

The linkage may be a covalent bond, and preferably a peptide bond. The fusion protein may optionally comprise at least one linker. Thus, the relaxin may not be directly linked to the Ig fragment. The linker may intervene between the relaxin and the Ig fragment. The linker can be linked to the N-terminus of the Ig fragment or the C-terminus of the Ig fragment. In one embodiment, the linker includes amino acids. The linker may include 1-5 amino acids.

Sequence Optimization of Nucleotide Sequence Encoding a Relaxin Polypeptide

In some embodiments, the polynucleotide (e.g., a RNA, e.g., an mRNA) of the invention is sequence optimized. In some embodiments, the polynucleotide (e.g., a RNA, e.g., an mRNA) of the invention comprises a nucleotide sequence (e.g., an ORF) encoding a relaxin polypeptide, a nucleotide sequence (e.g., an ORF) encoding another polypeptide of interest, a 5'-UTR, a 3'-UTR, a miRNA, a nucleotide sequence encoding a linker, or any combination thereof) that is sequence optimized.

A sequence-optimized nucleotide sequence, e.g., a codon-optimized mRNA sequence encoding a relaxin polypeptide, is a sequence comprising at least one synonymous nucleobase substitution with respect to a reference sequence (e.g., a wild type nucleotide sequence encoding a relaxin polypeptide).

A sequence-optimized nucleotide sequence can be partially or completely different in sequence from the reference sequence. For example, a reference sequence encoding polyserine uniformly encoded by TCT codons can be sequence-optimized by having 100% of its nucleobases substituted (for each codon, T in position 1 replaced by A, C in position 2 replaced by G, and T in position 3 replaced by C) to yield a sequence encoding polyserine which would be uniformly encoded by AGC codons. The percentage of sequence identity obtained from a global pairwise alignment between the reference polyserine nucleic acid sequence and the sequence-optimized polyserine nucleic acid sequence would be 0%. However, the protein products from both sequences would be 100% identical.

Some sequence optimization (also sometimes referred to as codon optimization) methods are known in the art and can be useful to achieve one or more desired results. These results can include, e.g., matching codon frequencies in certain tissue targets and/or host organisms to ensure proper folding; biasing G/C content to increase mRNA stability or reduce secondary structures; minimizing tandem repeat codons or base runs that can impair gene construction or expression; customizing transcriptional and translational control regions; inserting or removing protein trafficking sequences; removing/adding post translation modification sites in an encoded protein (e.g., glycosylation sites); adding, removing or shuffling protein domains; inserting or deleting restriction sites; modifying ribosome binding sites and mRNA degradation sites; adjusting translational rates to allow the various domains of the protein to fold properly; and/or reducing or eliminating problem secondary structures within the polynucleotide. Sequence optimization tools, algorithms and services are known in the art, non-limiting examples include services from GeneArt (Life Technologies), DNA2.0 (Menlo Park Calif.) and/or proprietary methods.

Codon options for each amino acid are given in Table 1 below.

TABLE 1

Codon Options

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocysteine insertion element (SECIS) |
| Stop codons | Stop | TAA, TAG, TGA |

In some embodiments, a polynucleotide (e.g., a RNA, e.g., an mRNA) of the invention comprises a sequence-optimized nucleotide sequence (e.g., an ORF) encoding a relaxin polypeptide, a functional fragment, or a variant thereof, wherein the relaxin polypeptide, functional fragment, or a variant thereof encoded by the sequence-optimized nucleotide sequence has improved properties (e.g., compared to a relaxin polypeptide, functional fragment, or a variant thereof encoded by a reference nucleotide sequence that is not sequence optimized), e.g., improved properties related to expression efficacy after administration in vivo. Such properties include, but are not limited to, improving nucleic acid stability (e.g., mRNA stability), increasing translation efficacy in the target tissue, reducing the number of truncated proteins expressed, improving the folding or prevent misfolding of the expressed proteins, reducing toxicity of the expressed products, reducing cell death caused by the expressed products, increasing and/or decreasing protein aggregation.

In some embodiments, the sequence-optimized nucleotide sequence is codon optimized for expression in human subjects, having structural and/or chemical features that avoid one or more of the problems in the art, for example, features which are useful for optimizing formulation and delivery of nucleic acid-based therapeutics while retaining structural and functional integrity; overcoming a threshold of expression; improving expression rates; half-life and/or protein concentrations; optimizing protein localization; and avoiding deleterious bio-responses such as the immune response and/or degradation pathways.

In some embodiments, the polynucleotides of the invention comprise a nucleotide sequence (e.g., a nucleotide sequence (e.g, an ORF) encoding a relaxin polypeptide, a nucleotide sequence (e.g, an ORF) encoding another polypeptide of interest, a 5'-UTR, a 3'-UTR, a microRNA, a nucleic acid sequence encoding a linker, or any combination thereof) that is sequence-optimized according to a method comprising: (i) substituting at least one codon in a reference nucleotide sequence (e.g., an ORF encoding a relaxin polypeptide) with an alternative codon to increase or decrease uridine content to generate a uridine-modified sequence; (ii) substituting at least one codon in a reference nucleotide sequence (e.g., an ORF encoding a relaxin polypeptide) with an alternative codon having a higher codon frequency in the synonymous codon set; (iii) substituting at least one codon in a reference nucleotide sequence (e.g., an ORF encoding a relaxin polypeptide) with an alternative codon to increase G/C content; or (iv) a combination thereof.

In some embodiments, the sequence-optimized nucleotide sequence (e.g., an ORF encoding a relaxin polypeptide) has at least one improved property with respect to the reference nucleotide sequence.

In some embodiments, the sequence optimization method is multiparametric and comprises one, two, three, four, or more methods disclosed herein and/or other optimization methods known in the art.

Features, which can be considered beneficial in some embodiments of the invention, can be encoded by or within regions of the polynucleotide and such regions can be upstream (5') to, downstream (3') to, or within the region that encodes the relaxin polypeptide. These regions can be incorporated into the polynucleotide before and/or after sequence-optimization of the protein encoding region or open reading frame (ORF). Examples of such features include, but are not limited to, untranslated regions (UTRs), microRNA sequences, Kozak sequences, oligo(dT) sequences, poly-A tail, and detectable tags and can include multiple cloning sites that can have XbaI recognition.

In some embodiments, the polynucleotide of the invention comprises a 5' UTR. a 3' UTR and/or a miRNA. In some embodiments, the polynucleotide comprises two or more 5' UTRs and/or 3' UTRs, which can be the same or different sequences. In some embodiments, the polynucleotide comprises two or more miRNA, which can be the same or different sequences. Any portion of the 5' UTR, 3' UTR, and/or miRNA, including none, can be sequence-optimized and can independently contain one or more different structural or chemical modifications, before and/or after sequence optimization.

In some embodiments, after optimization, the polynucleotide is reconstituted and transformed into a vector such as, but not limited to, plasmids, viruses, cosmids, and artificial chromosomes. For example, the optimized polynucleotide can be reconstituted and transformed into chemically competent E. coli, yeast, neurospora, maize, drosophila, etc. where high copy plasmid-like or chromosome structures occur by methods described herein.

Sequence-Optimized Nucleotide Sequences Encoding Relaxin Polypeptides

In some embodiments, the polynucleotide of the invention comprises a sequence-optimized nucleotide sequence encoding a relaxin polypeptide disclosed herein. In some embodiments, the polynucleotide of the invention comprises an open reading frame (ORF) encoding a relaxin polypeptide, wherein the ORF has been sequence optimized.

The sequence-optimized nucleotide sequences disclosed herein are distinct from the corresponding wild type nucleotide acid sequences and from other known sequence-optimized nucleotide sequences, e.g., these sequence-optimized nucleic acids have unique compositional characteristics.

In some embodiments, the percentage of uracil or thymine nucleobases in a sequence-optimized nucleotide sequence (e.g., encoding a relaxin polypeptide, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence. The percentage of uracil or thymine content in a nucleotide sequence can be determined by dividing the number of uracils or thymines in a sequence by the total number of nucleotides and multiplying by 100. In some embodiments, the sequence-optimized nucleotide sequence has a lower uracil or thymine content than the uracil or thymine content in the reference wild-type sequence. In some embodiments, the uracil or thymine content in a sequence-optimized nucleotide sequence of the invention is greater than the uracil or thymine content in the reference wild-type sequence and still maintain beneficial effects, e.g., increased expression and/or reduced Toll-Like Receptor (TLR) response when compared to the reference wild-type sequence.

The uracil or thymine content of a sequence disclosed herein, i.e., its total uracil or thymine content is abbreviated herein as % $U_{TL}$ or % $T_{TL}$.

A uracil- or thymine-modified sequence encoding a relaxin polypeptide of the invention can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

The phrases "uracil or thymine content relative to the uracil or thymine content in the wild type nucleic acid sequence," refers to a parameter determined by dividing the number of uracils or thymines in a sequence-optimized nucleic acid by the total number of uracils or thymines in the corresponding wild-type nucleic acid sequence and multiplying by 100. This parameter is abbreviated herein as % $U_{WT}$ or % $T_{WT}$.

Uracil- or thymine-content relative to the uracil or thymine theoretical minimum, refers to a parameter determined by dividing the number of uracils or thymines in a sequence-optimized nucleotide sequence by the total number of uracils or thymines in a hypothetical nucleotide sequence in which all the codons in the hypothetical sequence are replaced with synonymous codons having the lowest possible uracil or thymine content and multiplying by 100. This parameter is abbreviated herein as % $U_{TM}$ or % $T_{TM}$.

In some embodiments, the % $U_{TM}$ of a uracil-modified sequence encoding a relaxin polypeptide of the invention is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding a relaxin polypeptide of the invention is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, or above 130%, above 131%, above 132%, above 133%, above 134%, above 135%, above 136%, above 137%, or above 138%.

In some embodiments, the % $U_{TM}$ of a uracil-modified sequence encoding a relaxin polypeptide of the invention is between 131% and 133%, between 130% and 134%, between 129% and 135%, between 128% and 136%, between 127% and 137%, between 126% and 138%, between 125% and 139%, between 124% and 140%, between 123% and 141%, between 122% and 142%, between 121% and 143%, between 120% and 144%, or between 119% and 145%.

In some embodiments, the % $U_{TM}$ of a uracil-modified sequence encoding a relaxin polypeptide of the invention is between about 125% and about 139%, e.g., between 125% and 138%.

In some embodiments, a uracil-modified sequence encoding a relaxin polypeptide of the invention has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide. For example, if the polypeptide, e.g., wild type relaxin protein has, e.g., 12, 13, 14, 15, 16, 17, 18, 19, 20, 21, 22, or 23 phenylalanines, the absolute minimum number of uracil pairs (UU) that a uracil-modified sequence encoding the polypeptide, e.g., wild type relaxin protein can contain is 12, 13, 14, 15, 16, 17, 18, 19, 20, 21, 22, or 23, respectively.

In some embodiments, a uracil-modified sequence encoding a relaxin polypeptide has a reduced number of uracil pairs (UU) with respect to the number of uracil pairs (UU) in the wild-type nucleic acid sequence. In some embodiments, a uracil-modified sequence encoding a relaxin polypeptide of the invention has a number of uracil pairs (UU) corresponding to the minimum possible number of uracil pairs (UU) in the wild-type nucleic acid sequence.

In some embodiments, a uracil-modified sequence encoding a relaxin polypeptide of the invention has at least 1, 2, 3, 4, 5, 6, 7, 8, 9, 10, 11, 12, 13, 14, 15, 16, or 17 uracil pairs (UU) less than the number of uracil pairs (UU) in the wild-type nucleic acid sequence. In some embodiments, a uracil-modified sequence encoding a relaxin polypeptide of the invention has between 13 and 29 uracil pairs (UU).

The phrase "uracil pairs (UU) relative to the uracil pairs (UU) in the wild type nucleic acid sequence," refers to a parameter determined by dividing the number of uracil pairs (UU) in a sequence-optimized nucleotide sequence by the total number of uracil pairs (UU) in the corresponding wild-type nucleotide sequence and multiplying by 100. This parameter is abbreviated herein as % $UU_{wt}$.

In some embodiments, the polynucleotide of the invention comprises a uracil-modified sequence encoding a relaxin polypeptide disclosed herein. In some embodiments, the uracil-modified sequence encoding a relaxin polypeptide comprises at least one chemically modified nucleobase, e.g., 5-methoxyuracil. In some embodiments, at least 95% of a nucleobase (e.g., uracil) in a uracil-modified sequence encoding a relaxin polypeptide of the invention are modified nucleobases. In some embodiments, at least 95% of uracil in a uracil-modified sequence encoding a relaxin polypeptide is 5-methoxyuracil. In some embodiments, the polynucleotide comprising a uracil-modified sequence further comprises a miRNA binding site, e.g., a miRNA binding site that binds to miR-142. In some embodiments, the polynucleotide comprising a uracil-modified sequence is formulated with a delivery agent, e.g., a LNP comprising, for instance, a lipid having Formula (I), (IA), (II), (IIa), (IIb), (IIc), (IId) or (IIe), e.g., any of Compounds 1-232.

In some embodiments, the polynucleotide of the invention comprises an open reading frame (ORF) encoding a relaxin polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in the reference nucleic acid sequence encoding a relaxin protein are substituted with alternative codons, each alternative codon having a codon frequency higher than the codon frequency of the substituted codon in the synonymous codon set.

In some embodiments, at least one alternative codon having a higher codon frequency has the highest codon frequency in the synonymous codon set. In other embodiments, all alternative codons having a higher codon frequency have the highest codon frequency in the synonymous codon set.

In some embodiments, at least one alternative codon having a lower codon frequency has the lowest codon frequency in the synonymous codon set. In some embodiments, all alternative codons having a higher codon frequency have the highest codon frequency in the synonymous codon set.

In some specific embodiments, at least one alternative codon has the second highest, the third highest, the fourth highest, the fifth highest or the sixth highest frequency in the synonymous codon set. In some specific embodiments, at least one alternative codon has the second lowest, the third lowest, the fourth lowest, the fifth lowest, or the sixth lowest frequency in the synonymous codon set.

Optimization based on codon frequency can be applied globally, as described above, or locally to the reference nucleic acid sequence encoding a relaxin polypeptide. In some embodiments, when applied locally, regions of the reference nucleic acid sequence can be modified based on codon frequency, substituting all or a certain percentage of codons in a certain subsequence with codons that have higher or lower frequencies in their respective synonymous codon sets. Thus, in some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in a subsequence of the reference nucleic acid sequence are substituted with alternative codons, each alternative codon having a codon frequency higher than the codon frequency of the substituted codon in the synonymous codon set.

In some embodiments, at least one codon in a subsequence of the reference nucleic acid sequence encoding a relaxin polypeptide is substituted with an alternative codon having a codon frequency higher than the codon frequency of the substituted codon in the synonymous codon set, and at least one codon in a subsequence of the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in a subsequence of the reference nucleic acid sequence encoding a relaxin polypeptide are substituted with alternative codons, each alternative codon having a codon frequency higher than the codon frequency of the substituted codon in the synonymous codon set.

In some embodiments, at least one alternative codon substituted in a subsequence of the reference nucleic acid sequence encoding a relaxin polypeptide and having a higher codon frequency has the highest codon frequency in the synonymous codon set. In other embodiments, all alternative codons substituted in a subsequence of the reference nucleic acid sequence and having a lower codon frequency have the lowest codon frequency in the synonymous codon set.

In some embodiments, at least one alternative codon substituted in a subsequence of the reference nucleic acid sequence encoding a relaxin polypeptide and having a lower codon frequency has the lowest codon frequency in the synonymous codon set. In some embodiments, all alternative codons substituted in a subsequence of the reference nucleic acid sequence and having a higher codon frequency have the highest codon frequency in the synonymous codon set.

In specific embodiments, a sequence optimized nucleic acid encoding a relaxin polypeptide can comprise a subsequence having an overall codon frequency higher or lower than the overall codon frequency in the corresponding subsequence of the reference nucleic acid sequence at a specific location, for example, at the 5' end or 3' end of the sequence optimized nucleic acid, or within a predetermined distance from those region (e.g., at least 1, 2, 3, 4, 5, 6, 7, 8, 9, 10, 15, 20, 25, 30, 35, 40, 45, 50, 55, 60, 65, 70, 75, 80, 85, 90, 95 or 100 codons from the 5' end or 3' end of the sequence optimized nucleic acid).

In some embodiments, a sequence optimized nucleic acid encoding a relaxin polypeptide can comprise more than one subsequence having an overall codon frequency higher or lower than the overall codon frequency in the corresponding subsequence of the reference nucleic acid sequence. A skilled artisan would understand that subsequences with overall higher or lower overall codon frequencies can be organized in innumerable patterns, depending on whether the overall codon frequency is higher or lower, the length of the subsequence, the distance between subsequences, the location of the subsequences, etc.

Modified Nucleotide Sequences Encoding Relaxin Polypeptides

In some embodiments, the polynucleotide (e.g., a RNA, e.g., an mRNA) of the invention comprises a chemically modified nucleobase. The invention includes modified polynucleotides comprising a polynucleotide described herein (e.g., a polynucleotide comprising a nucleotide sequence encoding a relaxin polypeptide). The modified polynucleotides can be chemically modified and/or structurally modified. When the polynucleotides of the present invention are chemically and/or structurally modified the polynucleotides can be referred to as "modified polynucleotides."

The present disclosure provides for modified nucleosides and nucleotides of a polynucleotide (e.g., RNA polynucleotides, such as mRNA polynucleotides) encoding a relaxin polypeptide. A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A "nucleotide" refers to a nucleoside including a phosphate group. Modified nucleotides can by synthesized by any useful method, such as, for example, chemically, enzymatically, or recombinantly, to include one or more modified or non-natural nucleosides. Polynucleotides can comprise a region or regions of linked nucleosides. Such regions can have variable backbone linkages. The linkages can be standard phosphodiester linkages, in which case the polynucleotides would comprise regions of nucleotides.

The modified polynucleotides disclosed herein can comprise various distinct modifications. In some embodiments, the modified polynucleotides contain one, two, or more (optionally different) nucleoside or nucleotide modifications. In some embodiments, a modified polynucleotide, introduced to a cell can exhibit one or more desirable properties, e.g., improved protein expression, reduced immunogenicity, or reduced degradation in the cell, as compared to an unmodified polynucleotide.

In some embodiments, a polynucleotide of the present invention (e.g., a polynucleotide comprising a nucleotide sequence encoding a relaxin polypeptide) is structurally modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" can be chemically modified to "AT-5meC-G". The same polynucleotide can be structurally modified from "ATCG" to "ATC-CCG". Here, the dinucleotide "CC" has been inserted, resulting in a structural modification to the polynucleotide.

In some embodiments, the polynucleotides of the present invention are chemically modified. As used herein in reference to a polynucleotide, the terms "chemical modification" or, as appropriate, "chemically modified" refer to modification with respect to adenosine (A), guanosine (G), uridine (U), or cytidine (C) ribo- or deoxyribonucleosides in one or more of their position, pattern, percent or population. Generally, herein, these terms are not intended to refer to the ribonucleotide modifications in naturally occurring 5'-terminal mRNA cap moieties.

In some embodiments, the polynucleotides of the present invention can have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine or 5-methoxyuridine. In another embodiment, the polynucleotides can have a uniform chemical modification of two, three, or four of the same nucleoside type throughout the entire polynucleotide (such as all uridines and all cytosines, etc. are modified in the same way).

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker can be incorporated into polynucleotides of the present disclosure.

The skilled artisan will appreciate that, except where otherwise noted, polynucleotide sequences set forth in the instant application will recite "T"s in a representative DNA sequence but where the sequence represents RNA, the "T"s would be substituted for "U"s.

Modifications of polynucleotides (e.g., RNA polynucleotides, such as mRNA polynucleotides) that are useful in the compositions, methods and synthetic processes of the present disclosure include, but are not limited to the following nucleotides, nucleosides, and nucleobases: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6,N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl)adenine; 2-(aminoalkyl)adenine; 2-(aminopropyl)adenine; 2-(halo) adenine; 2-(halo) adenine; 2-(propyl)adenine; 2'-Amino-2'-deoxy-ATP; 2'-Azido-2'-deoxy-ATP; 2'-Deoxy-2'-a-aminoadenosine TP; 2'-Deoxy-2'-a-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkynyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl)adenine; 8-(thiol)adenine; 8-azido-adenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl)cytosine; 5-(alkynyl)cytosine; 5-(halo)cytosine; 5-(propynyl)cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azidocytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thio-guanosine; 7-deaza-guanosine; 8-oxo-guanosine; N1-methyl-guanosine; α-thio-guanosine; 2 (propyl)guanine; 2-(alkyl)guanine; 2'-Amino-2'-deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-(alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b- azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromoguanosine TP; 9-Deaza-guanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-ethyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoyl-methyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethylaminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methyluridine), 5-methoxyuridine; 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; N1-methyl-pseudo-uracil; N1-ethyl-pseudo-uracil; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2(thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio) pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl)pseudo-UTP; 1-Methyl-pseudo-UTP; 1-Ethyl-pseudo-UTP; 2 (thio) pseudouracil; 2' deoxy uridine; 2' fluorouridine; 2-(thio) uracil; 2,4-(dithio)psuedouracil; 2' methyl, 2'amino, 2'azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl)uracil; 4 (thio)pseudouracil; 4-(thio)pseudouracil; 4-(thio)uracil; 4-thiouracil; 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio)uracil; 5 (methylaminomethyl)-4 (thio)uracil; 5 (propynyl)uracil; 5 (trifluoromethyl)uracil; 5-(2-aminopropyl)uracil; 5-(alkyl)-2-(thio) pseudouracil; 5-(alkyl)-2,4 (dithio)pseudouracil; 5-(alkyl)-4 (thio)pseudouracil; 5-(alkyl)pseudouracil; 5-(alkyl)uracil; 5-(alkynyl)uracil; 5-(allylamino)uracil; 5-(cyanoalkyl)uracil; 5-(dialkylaminoalkyl)uracil; 5-(dimethylaminoalkyl) uracil; 5-(guanidiniumalkyl)uracil; 5-(halo)uracil; 5-(1,3-diazole-1-alkyl)uracil; 5-(methoxy)uracil; 5-(methoxycarbonylmethyl)-2-(thio)uracil; 5-(methoxycarbonyl-methyl)uracil; 5-(methyl) 2(thio)uracil; 5-(methyl) 2,4 (dithio)uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio) uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; allyamino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl) pseudouridine TP; (E)-5-(2-Bromo-vinyl)ara-uridine TP; (E)-5-(2-Bromo-vinyl)uridine TP; (Z)-5-(2-Bromo-vinyl)ara-uridine TP; (Z)-5-(2-Bromo-vinyl)uridine TP; 1-(2,2,2-Trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl) pseudo-UTP; 1-(2-Amino-2-carboxyethyl)pseudo-UTP; 1-(2-Amino-ethyl)pseudo-UTP; 1-(2-Hydroxyethyl) pseudouridine TP; 1-(2-Methoxyethyl)pseudouridine TP; 1-(3,4-Bis-trifluoromethoxybenzyl)pseudouridine TP; 1-(3,4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl) pseudo-UTP; 1-(4-Amino-butyl)pseudo-UTP; 1-(4-Amino-phenyl)pseudo-UTP; 1-(4-Azidobenzyl)pseudouridine TP; 1-(4-Bromobenzyl)pseudouridine TP; 1-(4-Chlorobenzyl) pseudouridine TP; 1-(4-Fluorobenzyl)pseudouridine TP; 1-(4-Iodobenzyl)pseudouridine TP; 1-(4-Methanesulfonyl-benzyl)pseudouridine TP; 1-(4-Methoxybenzyl)pseudouridine TP; 1-(4-Methoxy-benzyl)pseudo-UTP; 1-(4-Methoxy-phenyl)pseudo-UTP; 1-(4-Methylbenzyl)pseudouridine TP; 1-(4-Methyl-benzyl)pseudo-UTP; 1-(4-Nitrobenzyl) pseudouridine TP; 1-(4-Nitro-benzyl)pseudo-UTP; 1(4-Nitro-phenyl)pseudo-UTP; 1-(4-Thiomethoxybenzyl) pseudouridine TP; 1-(4-Trifluoromethoxybenzyl) pseudouridine TP; 1-(4-Trifluoromethylbenzyl)

pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl}pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl)pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenylpseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy}]propionic acid; Pseudouridine TP 1-[3-{2-(2-[2-{2 (2-ethoxy)-ethoxy}-ethoxy]-ethoxy)-ethoxy}]propionic acid; Pseudouridine TP 1-[3-{2-(2-[2-ethoxy]-ethoxy)-ethoxy}]propionic acid; Pseudouridine TP 1-[3-{2-(2-ethoxy)-ethoxy}]propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine; 1-(aza)-2-(thio)-3-(aza)-phenoxazin-1-yl; 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2 (amino)purine; 2,4,5-(trimethyl)phenyl; 2' methyl, 2'amino, 2'azido, 2'fluro-cytidine; 2' methyl, 2'amino, 2'azido, 2'fluro-adenine; 2'methyl, 2'amino, 2'azido, 2'fluro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl) isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl) isocarbostyrilyl; 7-(propynyl)isocarbostyrilyl, propynyl-7-

(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; 06-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-amino-pyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thiozebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'—OH-ara-guanosine TP; 5-(2-carbomethoxyvinyl) uridine TP; and N6-(19-Amino-pentaoxanonadecyl)adenosine TP.

In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, the mRNA comprises at least one chemically modified nucleoside. In some embodiments, the at least one chemically modified nucleoside is selected from the group consisting of pseudouridine (ψ), 2-thiouridine (s2U), 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine, 2'-O-methyl uridine, 1-methyl-pseudouridine (m1ψ), 1-ethyl-pseudouridine (e1ψ), 5-methoxy-uridine (mo5U), 5-methyl-cytidine (m5C), α-thio-guanosine, α-thio-adenosine, 5-cyano uridine, 4'-thio uridine 7-deaza-adenine, 1-methyl-adenosine (m1A), 2-methyl-adenine (m2A), N6-methyl-adenosine (m6A), and 2,6-Diaminopurine, (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine, 2,8-dimethyl-adenosine, 2-geranylthiouridine, 2-lysidine, 2-selenouridine, 3-(3-amino-3-carboxypropyl)-5,6-dihydrouridine, 3-(3-amino-3-carboxypropyl)pseudouridine, 3-methylpseudouridine, 5-(carboxyhydroxymethyl)-2'-O-methyluridine methyl ester, 5-aminomethyl-2-geranylthiouridine, 5-aminomethyl-2-selenouridine, 5-aminomethyluridine, 5-carbamoylhydroxymethyluridine, 5-carbamoylmethyl-2-thiouridine, 5-carboxymethyl-2-thiouridine, 5-carboxymethylaminomethyl-2-geranylthiouridine, 5-carboxymethylaminomethyl-2-selenouridine, 5-cyanomethyluridine, 5-hydroxycytidine, 5-methylaminomethyl-2-geranylthiouridine, 7-aminocarboxypropyl-demethylwyosine, 7-aminocarboxypropylwyosine, 7-aminocarboxypropylwyosine methyl ester, 8-methyladenosine, N4,N4-dimethylcytidine, N6-formyladenosine, N6-hydroxymethyladenosine, agmatidine, cyclic N6-threonylcarbamoyladenosine, glutamyl-queuosine, methylated undermodified hydroxywybutosine, N4,N4,2'-O-trimethylcytidine, geranylated 5-methylaminomethyl-2-thiouridine, geranylated 5-carboxymethylaminomethyl-2-thiouridine, Qbase, preQ0base, preQ1base, and two or more combinations thereof. In some embodiments, the at least one chemically modified nucleoside is selected from the group consisting of pseudouridine, 1-methyl-pseudouridine, 1-ethyl-pseudouridine, 5-methylcytosine, 5-methoxyuridine, and a combination thereof. In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, the mRNA is a uracil-modified sequence comprising an ORF encoding a relaxin polypeptide, wherein the mRNA comprises a chemically modified nucleobase, e.g., 5-methoxyuracil. In certain aspects of the invention, when the 5-methoxyuracil base is connected to a ribose sugar, as it is in polynucleotides, the resulting modified nucleoside or nucleotide is referred to as 5-methoxyuridine. In some embodiments, uracil in the polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the polynucleotide is at least 95% 5-methoxyuracil. In another embodiment, uracil in the polynucleotide is 100% 5-methoxyuracil.

In embodiments where uracil in the polynucleotide is at least 95% 5-methoxyuracil, overall uracil content can be adjusted such that an mRNA provides suitable protein expression levels while inducing little to no immune response. In some embodiments, the uracil content of the ORF is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140% of the theoretical minimum uracil content in the corresponding wild-type ORF (% Utm). In other embodiments, the uracil content of the ORF is between about 117% and about 134% or between 118% and 132% of the % UTM. In some embodiments, the uracil content of the ORF encoding a relaxin polypeptide is about 115%, about 120%, about 125%, about 130%, about 135%, about 140%, about 145%, or about 150% of the % Utm. In this context, the term "uracil" can refer to 5-methoxyuracil and/or naturally occurring uracil.

In some embodiments, the uracil content in the ORF of the mRNA encoding a relaxin polypeptide of the invention is less than about 50%, about 40%, about 30%, about 20%, about 15%, or about 12% of the total nucleobase content in the ORF. In some embodiments, the uracil content in the ORF is between about 12% and about 25% of the total nucleobase content in the ORF. In other embodiments, the uracil content in the ORF is between about 15% and about 17% of the total nucleobase content in the ORF. In one embodiment, the uracil content in the ORF of the mRNA encoding a relaxin polypeptide is less than about 20% of the total nucleobase content in the open reading frame. In this context, the term "uracil" can refer to 5-methoxyuracil and/or naturally occurring uracil.

In further embodiments, the ORF of the mRNA encoding a relaxin polypeptide of the invention comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the relaxin polypeptide. In some embodiments, the ORF of the mRNA encoding a relaxin polypeptide of the invention contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the relaxin polypeptide. In a particular embodiment, the ORF of the mRNA encoding the relaxin polypeptide of the invention contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the relaxin polypeptide contains no non-phenylalanine uracil pairs and/or triplets.

In further embodiments, the ORF of the mRNA encoding a relaxin polypeptide of the invention comprises 5-methoxyuracil and has an adjusted uracil content containing less uracil-rich clusters than the corresponding wild-type nucleotide sequence encoding the relaxin polypeptide. In some embodiments, the ORF of the mRNA encoding the relaxin polypeptide of the invention contains uracil-rich clusters that are shorter in length than corresponding uracil-rich clusters in the corresponding wild-type nucleotide sequence encoding the relaxin polypeptide.

In further embodiments, alternative lower frequency codons are employed. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the relaxin polypeptide-encoding ORF of the 5-methoxyuracil-comprising mRNA are substituted with alternative codons, each alternative codon having a codon frequency lower than the codon frequency of the substituted codon in the synonymous codon set. The ORF also has adjusted uracil content, as described above. In some embodiments, at least one codon in the ORF of the mRNA encoding the relaxin polypeptide is substituted with an alternative codon having a codon frequency lower than the codon frequency of the substituted codon in the synonymous codon set.

In some embodiments, the adjusted uracil content, of the relaxin polypeptide-encoding ORF of the 5-methoxyuracil-comprising mRNA exhibits expression levels of the relaxin protein when administered to a mammalian cell that are higher than expression levels of the relaxin protein from the corresponding wild-type mRNA. In other embodiments, the expression levels of the relaxin protein when administered to a mammalian cell are increased relative to a corresponding mRNA containing at least 95% 5-methoxyuracil and having a uracil content of about 160%, about 170%, about 180%, about 190%, or about 200% of the theoretical minimum. In yet other embodiments, the expression levels of the relaxin protein when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, a relaxin protein is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the relaxin polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, adjusted uracil content, a relaxin polypeptide-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the mRNA exhibits increased stability including resistance to nucleases, thermal stability, and/or increased stabilization of secondary structure. In some embodiments, increased stability exhibited by the mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the mRNA of the present invention induces a detectably lower immune response (e.g., innate or acquired) relative to the immune response induced by a corresponding wild-type mRNA under the same conditions. In other embodiments, the mRNA of the present disclosure induces a detectably lower immune response (e.g., innate or acquired) relative to the immune response induced by an mRNA that encodes for a relaxin polypeptide but does not comprise 5-methoxyuracil under the same conditions, or relative to the immune response induced by an mRNA that encodes for a relaxin polypeptide and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ) or the expression of interferon-regulated genes such as the toll-like receptors (e.g., TLR7 and TLR8), and/or by decreased cell death following one or more administrations of the mRNA of the invention into a cell.

In some embodiments, the expression of Type-1 interferons by a mammalian cell in response to the mRNA of the present disclosure is reduced by at least 10%, 20%, 30%, 40%, 50%, 60%, 70%, 80%, 90%, 95%, 99%, 99.9%, or greater than 99.9% relative to a corresponding wild-type mRNA, to an mRNA that encodes a relaxin polypeptide but does not comprise 5-methoxyuracil, or to an mRNA that encodes a relaxin polypeptide and that comprises 5-methoxyuracil but that does not have adjusted uracil content. In some embodiments, the interferon is IFN-β. In some embodiments, cell death frequency cased by administration of mRNA of the present disclosure to a mammalian cell is 10%, 25%, 50%, 75%, 85%, 90%, 95%, or over 95% less than the cell death frequency observed with a corresponding wild-type mRNA, an mRNA that encodes for a relaxin polypeptide but does not comprise 5-methoxyuracil, or an mRNA that encodes for a relaxin polypeptide and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the polynucleotide is an mRNA that comprises an ORF that encodes a relaxin polypeptide, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the relaxin polypeptide is less than about 23% of the total nucleobase content in the ORF. In some embodiments, the ORF that encodes the relaxin polypeptide is further modified to decrease G/C content of the ORF (absolute or relative) by at least about 40%, as compared to the corresponding wild-type ORF. In yet other embodiments, the ORF encoding the relaxin polypeptide contains less than 20 non-phenylalanine uracil pairs and/or triplets. In some embodiments, at least one codon in the ORF of the mRNA encoding the relaxin polypeptide is further substituted with an alternative codon having a codon frequency lower than the codon frequency of the substituted codon in the synonymous codon set. In some embodiments, the expression of the relaxin polypeptide encoded by an mRNA comprising an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the relaxin polypeptide from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

In certain embodiments, the chemical modification is at nucleobases in the polynucleotides (e.g., RNA polynucleotide, such as mRNA polynucleotide). In some embodiments, modified nucleobases in the polynucleotide (e.g., RNA polynucleotide, such as mRNA polynucleotide) are selected from the group consisting of 1-methyl-pseudouridine (m1ψ), 1-ethyl-pseudouridine (e1ψ), 5-methoxy-uridine (mo5U), 5-methyl-cytidine (m5C), pseudouridine (ψ), α-thio-guanosine and α-thio-adenosine. In some embodiments, the polynucleotide includes a combination of at least two (e.g., 2, 3, 4 or more) of the aforementioned modified nucleobases.

In some embodiments, the polynucleotide (e.g., RNA polynucleotide, such as mRNA polynucleotide) comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide (e.g., RNA polynucleotide, such as mRNA polynucleotide) comprises 1-ethyl-pseudouridine (e1ψ). In some embodiments, the polynucleotide (e.g., RNA polynucleotide, such as mRNA polynucleotide) comprises 1-methyl-pseudouridine (m1ψ) and 5-methyl-cytidine (m5C). In some embodiments, the polynucleotide (e.g., RNA polynucleotide, such as mRNA polynucleotide) comprises 1-ethyl-pseudouridine (e1ψ) and 5-methyl-cytidine (m5C). In some embodiments, the polynucleotide (e.g., RNA polynucleotide, such as mRNA polynucleotide) comprises 2-thiouridine (s2U). In some embodiments, the polynucleotide (e.g., RNA polynucleotide, such as mRNA polynucleotide) comprises 2-thiouridine and 5-methyl-cytidine (m5C). In some embodiments, the polynucleotide (e.g., RNA polynucleotide, such as mRNA polynucleotide) comprises methoxy-uridine (mo5U). In some embodiments, the polynucleotide (e.g., RNA polynucleotide, such as mRNA polynucleotide) comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine. In some embodiments, the polynucleotide (e.g., RNA polynucleotide, such as mRNA polynucleotide) comprises 2'-O-methyl uridine and 5-methyl-cytidine (m5C). In some embodiments, the polynucleotide (e.g., RNA polynucleotide, such as mRNA polynucleotide) comprises N6-methyl-adenosine (m6A). In some embodiments, the polynucleotide (e.g., RNA polynucleotide, such as mRNA polynucleotide) comprises N6-methyl-adenosine (m6A) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the chemically modified nucleosides in the open reading frame are selected from the group consisting of uridine, adenine, cytosine, guanine, and any combination thereof.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenine (m6A), and 2,6-Diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deazaguanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

In some embodiments, the nucleobase modified nucleotides in the polynucleotide (e.g., RNA polynucleotide, such as mRNA polynucleotide) are 5-methoxyuridine.

In some embodiments, the polynucleotide (e.g., RNA polynucleotide, such as mRNA polynucleotide) includes a combination of at least two (e.g., 2, 3, 4 or more) of modified nucleobases.

In some embodiments, the polynucleotide (e.g., RNA polynucleotide, such as mRNA polynucleotide) comprises 5-methoxyuridine (5mo5U) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methoxyuridine, meaning that substantially all uridine residues in the mRNA sequence are replaced with 5-methoxyuridine. Similarly, a polynucleotide can be uniformly modified for any type of nucleoside residue present in the sequence by replacement with a modified residue such as any of those set forth above.

In some embodiments, the modified nucleobase is a modified cytosine.

In some embodiments, a modified nucleobase is a modified uracil. Example nucleobases and nucleosides having a modified uracil include 5-methoxyuracil.

In some embodiments, a modified nucleobase is a modified adenine.

In some embodiments, a modified nucleobase is a modified guanine.

In some embodiments, the polynucleotides can include any useful linker between the nucleosides. Such linkers, including backbone modifications, that are useful in the composition of the present disclosure include, but are not limited to the following: 3'-alkylene phosphonates, 3'-amino phosphoramidate, alkene containing backbones, aminoalkylphosphoramidates, aminoalkylphosphotriesters, boranophosphates, —CH$_2$—O—N(CH$_3$)—CH$_2$—, —CH$_2$—N (CH$_3$)—N(CH$_3$)—CH$_2$—, —CH$_2$—NH—CH$_2$—, chiral phosphonates, chiral phosphorothioates, formacetyl and thioformacetyl backbones, methylene (methylimino), methylene formacetyl and thioformacetyl backbones, methyleneimino and methylenehydrazino backbones, morpholino linkages, —N(CH$_3$)—CH$_2$—CH$_2$—, oligonucleosides with heteroatom internucleoside linkage, phosphinates, phosphoramidates, phosphorodithioates, phosphorothioate internucleoside linkages, phosphorothioates, phosphotriesters, PNA, siloxane backbones, sulfamate backbones, sulfide sulfoxide and sulfone backbones, sulfonate and sulfonamide backbones, thionoalkylphosphonates, thionoalkylphosphotriesters, and thionophosphoramidates.

The modified nucleosides and nucleotides (e.g., building block molecules), which can be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_1$-6 alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), —O(CH$_2$CH$_2$O)$_n$CH$_2$CH$_2$OR, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Patent Publication Nos. WO2013052523 and WO2014093924, the contents of each of which are incorporated herein by reference in their entireties.

The polynucleotides of the invention (e.g., a polynucleotide comprising a nucleotide sequence encoding a relaxin polypeptide or a functional fragment or variant thereof) can include a combination of modifications to the sugar, the nucleobase, and/or the internucleoside linkage. These combinations can include any one or more modifications described herein.

Untranslated Regions (UTRs)

Untranslated regions (UTRs) are nucleic acid sections of a polynucleotide before a start codon (5'UTR) and after a stop codon (3'UTR) that are not translated. In some embodiments, a polynucleotide (e.g., a ribonucleic acid (RNA), e.g., a messenger RNA (mRNA)) of the invention comprising an open reading frame (ORF) encoding a relaxin polypeptide further comprises UTR (e.g., a 5'UTR or functional fragment thereof, a 3'UTR or functional fragment thereof, or a combination thereof).

A UTR can be homologous or heterologous to the coding region in a polynucleotide. In some embodiments, the UTR is homologous to the ORF encoding the relaxin polypeptide. In some embodiments, the UTR is heterologous to the ORF encoding the relaxin polypeptide. In some embodiments, the polynucleotide comprises two or more 5'UTRs or functional fragments thereof, each of which have the same or different nucleotide sequences. In some embodiments, the polynucleotide comprises two or more 3'UTRs or functional fragments thereof, each of which have the same or different nucleotide sequences.

In some embodiments, the 5'UTR or functional fragment thereof, 3' UTR or functional fragment thereof, or any combination thereof is sequence optimized.

In some embodiments, the 5'UTR or functional fragment thereof, 3' UTR or functional fragment thereof, or any combination thereof comprises at least one chemically modified nucleobase, e.g., 5-methoxyuracil.

UTRs can have features that provide a regulatory role, e.g., increased or decreased stability, localization and/or translation efficiency. A polynucleotide comprising a UTR can be administered to a cell, tissue, or organism, and one or more regulatory features can be measured using routine methods. In some embodiments, a functional fragment of a 5'UTR or 3'UTR comprises one or more regulatory features of a full length 5' or 3' UTR, respectively.

Natural 5'UTRs bear features that play roles in translation initiation. They harbor signatures like Kozak sequences that are commonly known to be involved in the process by which the ribosome initiates translation of many genes. Kozak sequences have the consensus CCR(A/G)CCAUGG (SEQ ID NO: 492), where R is a purine (adenine or guanine) three bases upstream of the start codon (AUG), which is followed by another 'G'. 5'UTRs also have been known to form secondary structures that are involved in elongation factor binding.

By engineering the features typically found in abundantly expressed genes of specific target organs, one can enhance the stability and protein production of a polynucleotide. For example, introduction of 5'UTR of liver-expressed mRNA, such as albumin, serum amyloid A, Apolipoprotein A/B/E, transferrin, alpha fetoprotein, erythropoietin, or Factor VIII, can enhance expression of polynucleotides in hepatic cell lines or liver. Likewise, use of 5'UTR from other tissue-specific mRNA to improve expression in that tissue is possible for muscle (e.g., MyoD, Myosin, Myoglobin, Myogenin, Herculin), for endothelial cells (e.g., Tie-1, CD36), for myeloid cells (e.g., C/EBP, AML1, G-CSF, GM-CSF, CD11b, MSR, Fr-1, i-NOS), for leukocytes (e.g., CD45, CD18), for adipose tissue (e.g., CD36, GLUT4, ACRP30, adiponectin) and for lung epithelial cells (e.g., SP-A/B/C/D).

In some embodiments, UTRs are selected from a family of transcripts whose proteins share a common function, structure, feature or property. For example, an encoded polypeptide can belong to a family of proteins (i.e., that share at least one function, structure, feature, localization, origin, or expression pattern), which are expressed in a particular cell, tissue or at some time during development. The UTRs from any of the genes or mRNA can be swapped for any other UTR of the same or different family of proteins to create a new polynucleotide.

In some embodiments, the 5'UTR and the 3'UTR can be heterologous. In some embodiments, the 5'UTR can be derived from a different species than the 3'UTR. In some embodiments, the 3'UTR can be derived from a different species than the 5'UTR.

Co-owned International Patent Application No. PCT/US2014/021522 (Publ. No. WO/2014/164253, incorporated herein by reference in its entirety) provides a listing of exemplary UTRs that can be utilized in the polynucleotide of the present invention as flanking regions to an ORF.

Exemplary UTRs of the application include, but are not limited to, one or more 5'UTR and/or 3'UTR derived from the nucleic acid sequence of: a globin, such as an α- or β-globin (e.g., a *Xenopus*, mouse, rabbit, or human globin); a strong Kozak translational initiation signal; a CYBA (e.g., human cytochrome b-245α polypeptide); an albumin (e.g., human albumin7); a HSD17B4 (hydroxysteroid (17-β) dehydrogenase); a virus (e.g., a tobacco etch virus (TEV), a Venezuelan equine encephalitis virus (VEEV), a Dengue virus, a cytomegalovirus (CMV) (e.g., CMV immediate early 1 (IE1)), a hepatitis virus (e.g., hepatitis B virus), a sindbis virus, or a PAV barley yellow dwarf virus); a heat shock protein (e.g., hsp70); a translation initiation factor (e.g., eIF4G); a glucose transporter (e.g., hGLUT1 (human glucose transporter 1)); an actin (e.g., human α or β actin); a GAPDH; a tubulin; a histone; a citric acid cycle enzyme; a topoisomerase (e.g., a 5'UTR of a TOP gene lacking the 5' TOP motif (the oligopyrimidine tract)); a ribosomal protein Large 32 (L32); a ribosomal protein (e.g., human or mouse ribosomal protein, such as, for example, rps9); an ATP synthase (e.g., ATP5A1 or the β subunit of mitochondrial $H^+$-ATP synthase); a growth hormone e (e.g., bovine (bGH) or human (hGH)); an elongation factor (e.g., elongation factor 1 α1 (EEF1A1)); a manganese superoxide dismutase (MnSOD); a myocyte enhancer factor 2A (MEF2A); a β-F1-ATPase, a creatine kinase, a myoglobin, a granulocyte-colony stimulating factor (G-CSF); a collagen (e.g., collagen type I, alpha 2 (Col1A2), collagen type I, alpha 1 (Col1A1), collagen type VI, alpha 2 (Col6A2), collagen type VI, alpha 1 (Col6A1)); a ribophorin (e.g., ribophorin I (RPNI)); a low density lipoprotein receptor-related protein (e.g., LRP1); a cardiotrophin-like cytokine factor (e.g., Nnt1); calreticulin (Calr); a procollagen-lysine, 2-oxoglutarate 5-dioxygenase 1 (Plod1); and a nucleobindin (e.g., Nucb1).

In some embodiments, the 5'UTR is selected from the group consisting of a β-globin 5'UTR; a 5'UTR containing a strong Kozak translational initiation signal; a cytochrome b-245α polypeptide (CYBA) 5'UTR; a hydroxysteroid (17-β) dehydrogenase (HSD17B4) 5'UTR; a Tobacco etch virus (TEV) 5'UTR; a Venezuelen equine encephalitis virus (TEEV) 5'UTR; a 5' proximal open reading frame of rubella virus (RV) RNA encoding nonstructural proteins; a Dengue virus (DEN) 5'UTR; a heat shock protein 70 (Hsp70) 5'UTR; a eIF4G 5'UTR; a GLUT1 5'UTR; functional fragments thereof and any combination thereof.

In some embodiments, the 3'UTR is selected from the group consisting of a β-globin 3'UTR; a CYBA 3'UTR; an albumin 3'UTR; a growth hormone (GH) 3'UTR; a VEEV 3'UTR; a hepatitis B virus (HBV) 3'UTR; α-globin 3'UTR; a DEN 3'UTR; a PAV barley yellow dwarf virus (BYDV-PAV) 3'UTR; an elongation factor 1 α1 (EEF1A1) 3'UTR; a manganese superoxide dismutase (MnSOD) 3'UTR; a β subunit of mitochondrial H(+)-ATP synthase (β-mRNA) 3'UTR; a GLUT1 3'UTR; a MEF2A 3'UTR; a β-F1-ATPase 3'UTR; functional fragments thereof and combinations thereof.

Wild-type UTRs derived from any gene or mRNA can be incorporated into the polynucleotides of the invention. In some embodiments, a UTR can be altered relative to a wild type or native UTR to produce a variant UTR, e.g., by changing the orientation or location of the UTR relative to the ORF; or by inclusion of additional nucleotides, deletion of nucleotides, swapping or transposition of nucleotides. In some embodiments, variants of 5' or 3' UTRs can be utilized, for example, mutants of wild type UTRs, or variants wherein one or more nucleotides are added to or removed from a terminus of the UTR.

Additionally, one or more synthetic UTRs can be used in combination with one or more non-synthetic UTRs. See, e.g., Mandal and Rossi, Nat. Protoc. 2013 8(3):568-82, and sequences available on the world wide web at addgene.org/Derrick_Rossi/, the contents of each are incorporated herein by reference in their entirety. UTRs or portions thereof can be placed in the same orientation as in the transcript from which they were selected or can be altered in orientation or location. Hence, a 5' and/or 3' UTR can be inverted, shortened, lengthened, or combined with one or more other 5' UTRs or 3' UTRs.

In some embodiments, the polynucleotide comprises multiple UTRs, e.g., a double, a triple or a quadruple 5'UTR or 3'UTR. For example, a double UTR comprises two copies of the same UTR either in series or substantially in series. For example, a double beta-globin 3'UTR can be used (see US2010/0129877, the contents of which are incorporated herein by reference in its entirety).

In certain embodiments, the polynucleotides of the invention comprise a 5'UTR and/or a 3'UTR selected from any of the UTRs disclosed herein. In some embodiments, the 5'UTR and/or the 3' UTR comprise:

| Name | SEQ ID NO: |
|---|---|
| 5'UTR-001 (Upstream UTR) | 545 |
| 5'UTR-002 (Upstream UTR) | 546 |
| 5'UTR-003 (Upstream UTR) | 547 |
| 5'UTR-004 (Upstream UTR) | 548 |
| 5'UTR-005 (Upstream UTR) | 549 |
| 5'UTR-006 (Upstream UTR) | 550 |
| 5'UTR-007 (Upstream UTR) | 551 |
| 5'UTR-008 (Upstream UTR) | 552 |
| 5'UTR-009 (Upstream UTR) | 553 |
| 5'UTR-010 (Upstream UTR) | 554 |
| 5'UTR-011 (Upstream UTR) | 555 |
| 5'UTR-012 (Upstream UTR) | 556 |
| 5'UTR-013 (Upstream UTR) | 557 |
| 5'UTR-014 (Upstream UTR) | 558 |
| 5'UTR-015 (Upstream UTR) | 559 |
| 5'UTR-016 (Upstream UTR) | 560 |
| 5'UTR-017 (Upstream UTR) | 561 |
| 5'UTR-018 (Upstream UTR) | 562 |
| 142-3p 5'UTR-001 (Upstream UTR including miR142-3p binding site) | 563 |
| 142-3p 5'UTR-002 (Upstream UTR including miR142-3p binding site) | 564 |
| 142-3p 5'UTR-003 (Upstream UTR including miR142-3p binding site) | 565 |
| 142-3p 5'UTR-004 (Upstream UTR including miR142-3p binding site) | 566 |
| 142-3p 5'UTR-005 (Upstream UTR including miR142-3p binding site) | 567 |
| 142-3p 5'UTR-006 (Upstream UTR including miR142-3p binding site) | 568 |
| 142-3p 5'UTR-007 (Upstream UTR including miR142-3p binding site) | 569 |
| 3'UTR comprises: 3'UTR-001 (Creatine Kinase UTR) | 570 |
| 3'UTR-002 (Myoglobin UTR) | 571 |
| 3'UTR-003 (α-actin UTR) | 572 |
| 3'UTR-004 (Albumin UTR) | 573 |
| 3'UTR-005 (α-globin UTR) | 574 |
| 3'UTR-006 (G-CSF UTR) | 575 |
| 3'UTR-007 (Col1a2; collagen, type I, alpha 2 UTR) | 576 |
| 3'UTR-008 (Col6a2; collagen, type VI, alpha 2 UTR) | 577 |
| 3'UTR-009 (RPN1; ribophorin I UTR) | 578 |
| 3'UTR-010 (LRP1; low density lipoprotein receptor-related protein 1 UTR) | 579 |
| 3'UTR-011 (Nnt1; cardiotrophin-like cytokine factor 1 UTR) | 580 |
| 3'UTR-012 (Col6a1; collagen, type VI, alpha 1 UTR) | 581 |

-continued

| Name | SEQ ID NO: |
|---|---|
| 3'UTR-013 (Calr; calreticulin UTR) | 582 |
| 3'UTR-014 (Col1a1; collagen, type I, alpha 1 UTR) | 583 |
| 3'UTR-015 (Plod1; procollagen-lysine, 2-oxoglutarate 5-dioxygenase 1 UTR) | 584 |
| 3'UTR-016 (Nucb1; nucleobindin 1 UTR) | 585 |
| 3'UTR-017 (α-globin) | 586 |
| 3'UTR-018 | 587 |
| 3' UTR with miR 142-3p binding site | 493 |
| 3' UTR with miR 126-3p binding site | 494 |
| 3' UTR with miR 142-3p and miR 126-3p binding sites | 495 |
| 3' UTR with 3 miR 142-3p binding sites | 496 |
| 3'UTR with miR 142-5p binding site | 497 |
| 3'UTR with 3 miR 142-5p binding sites | 498 |
| 3'UTR with 2 miR 142-5p binding sites and 1 miR 142-3p binding site | 499 |
| 3'UTR with miR 142-3p binding site, P1 insertion | 500 |
| 3'UTR with miR 142-3p binding site, P2 insertion | 501 |
| 3'UTR with miR 142-3p binding site, P3 insertion | 502 |
| 3'UTR with miR 155-5p binding site | 503 |
| 3' UTR with 3 miR 155-5p binding sites | 504 |
| 3'UTR with 2 miR 155-5p binding sites and 1 miR 142-3p binding site | 505 |

In certain embodiments, the 5'UTR and/or 3'UTR sequence of the invention comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of 5'UTR sequences comprising any of SEQ ID NOs: 545-569 and/or 3'UTR sequences comprises any of SEQ ID NOs: 493-505 and 570-587, and any combination thereof.

The polynucleotides of the invention can comprise combinations of features. For example, the ORF can be flanked by a 5'UTR that comprises a strong Kozak translational initiation signal and/or a 3'UTR comprising an oligo(dT) sequence for templated addition of a poly-A tail. A 5'UTR can comprise a first polynucleotide fragment and a second polynucleotide fragment from the same and/or different UTRs (see, e.g., US2010/0293625, herein incorporated by reference in its entirety).

Other non-UTR sequences can be used as regions or subregions within the polynucleotides of the invention. For example, introns or portions of intron sequences can be incorporated into the polynucleotides of the invention. Incorporation of intronic sequences can increase protein production as well as polynucleotide expression levels. In some embodiments, the polynucleotide of the invention comprises an internal ribosome entry site (IRES) instead of or in addition to a UTR (see, e.g., Yakubov et al., Biochem. Biophys. Res. Commun. 2010 394(1):189-193, the contents of which are incorporated herein by reference in their entirety). In some embodiments, the polynucleotide comprises an IRES instead of a 5'UTR sequence. In some embodiments, the polynucleotide comprises an ORF and a viral capsid sequence. In some embodiments, the polynucleotide comprises a synthetic 5'UTR in combination with a non-synthetic 3'UTR.

In some embodiments, the UTR can also include at least one translation enhancer polynucleotide, translation enhancer element, or translational enhancer elements (collectively, "TEE," which refers to nucleic acid sequences that increase the amount of polypeptide or protein produced from a polynucleotide. As a non-limiting example, the TEE can include those described in US2009/0226470, incorporated herein by reference in its entirety, and others known in the art. As a non-limiting example, the TEE can be located between the transcription promoter and the start codon. In some embodiments, the 5'UTR comprises a TEE.

In one aspect, a TEE is a conserved element in a UTR that can promote translational activity of a nucleic acid such as, but not limited to, cap-dependent or cap-independent translation.

In one non-limiting example, the TEE comprises the TEE sequence in the 5'-leader of the Gtx homeodomain protein. See Chappell et al., PNAS 2004 101:9590-9594, incorporated herein by reference in its entirety.

"Translational enhancer polynucleotide" or "translation enhancer polynucleotide sequence" refer to a polynucleotide that includes one or more of the TEE provided herein and/or known in the art (see. e.g., U.S. Pat. Nos. 6,310,197, 6,849,405, 7,456,273, 7,183,395, US2009/0226470, US2007/0048776, US2011/0124100, US2009/0093049, US2013/0177581, WO2009/075886, WO2007/025008, WO2012/009644, WO2001/055371, WO1999/024595, EP2610341A1, and EP2610340A1; the contents of each of which are incorporated herein by reference in their entirety), or their variants, homologs, or functional derivatives. In some embodiments, the polynucleotide of the invention comprises one or multiple copies of a TEE. The TEE in a translational enhancer polynucleotide can be organized in one or more sequence segments. A sequence segment can harbor one or more of the TEEs provided herein, with each TEE being present in one or more copies. When multiple sequence segments are present in a translational enhancer polynucleotide, they can be homogenous or heterogeneous. Thus, the multiple sequence segments in a translational enhancer polynucleotide can harbor identical or different types of the TEE provided herein, identical or different number of copies of each of the TEE, and/or identical or different organization of the TEE within each sequence segment. In one embodiment, the polynucleotide of the invention comprises a translational enhancer polynucleotide sequence.

In some embodiments, a 5'UTR and/or 3'UTR comprising at least one TEE described herein can be incorporated in a monocistronic sequence such as, but not limited to, a vector system or a nucleic acid vector.

In some embodiments, a 5'UTR and/or 3'UTR of a polynucleotide of the invention comprises a TEE or portion thereof described herein. In some embodiments, the TEEs in the 3'UTR can be the same and/or different from the TEE located in the 5'UTR.

In some embodiments, a 5'UTR and/or 3'UTR of a polynucleotide of the invention can include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. In one embodiment, the 5'UTR of a polynucleotide of the invention can include 1-60, 1-55, 1-50, 1-45, 1-40, 1-35, 1-30, 1-25, 1-20, 1-15, 1-10, 9, 8, 7, 6, 5, 4, 3, 2, or 1 TEE sequences. The TEE sequences in the 5'UTR of the polynucleotide of the invention can be the same or different TEE sequences. A combination of different TEE sequences in the 5'UTR of the polynucleotide of the invention can include combinations in which more than one copy of any of the different TEE sequences are incorporated.

In some embodiments, the 5'UTR and/or 3'UTR comprises a spacer to separate two TEE sequences. As a non-limiting example, the spacer can be a 15 nucleotide spacer and/or other spacers known in the art. As another non-limiting example, the 5'UTR and/or 3'UTR comprises a TEE sequence-spacer module repeated at least once, at least twice, at least 3 times, at least 4 times, at least 5 times, at least 6 times, at least 7 times, at least 8 times, at least 9 times, at least 10 times, or more than 10 times in the 5'UTR and/or 3'UTR, respectively. In some embodiments, the 5'UTR and/or 3'UTR comprises a TEE sequence-spacer module repeated 1, 2, 3, 4, 5, 6, 7, 8, 9, or 10 times.

In some embodiments, the spacer separating two TEE sequences can include other sequences known in the art that can regulate the translation of the polynucleotide of the invention, e.g., miR sequences described herein (e.g., miR binding sites and miR seeds). As a non-limiting example, each spacer used to separate two TEE sequences can include a different miR sequence or component of a miR sequence (e.g., miR seed sequence).

In some embodiments, a polynucleotide of the invention comprises a miR and/or TEE sequence. In some embodiments, the incorporation of a miR sequence and/or a TEE sequence into a polynucleotide of the invention can change the shape of the stem loop region, which can increase and/or decrease translation. See e.g., Kedde et al., Nature Cell Biology 2010 12(10):1014-20, herein incorporated by reference in its entirety).

MicroRNA (miRNA) Binding Sites

Polynucleotides of the invention can include regulatory elements, for example, microRNA (miRNA) binding sites, transcription factor binding sites, structured mRNA sequences and/or motifs, artificial binding sites engineered to act as pseudo-receptors for endogenous nucleic acid binding molecules, and combinations thereof. In some embodiments, polynucleotides including such regulatory elements are referred to as including "sensor sequences". Non-limiting examples of sensor sequences are described in U.S. Publication 2014/0200261, the contents of which are incorporated herein by reference in their entirety.

In some embodiments, a polynucleotide (e.g., a ribonucleic acid (RNA), e.g., a messenger RNA (mRNA)) of the invention comprises an open reading frame (ORF) encoding a polypeptide of interest and further comprises one or more miRNA binding site(s). Inclusion or incorporation of miRNA binding site(s) provides for regulation of polynucleotides of the invention, and in turn, of the polypeptides encoded therefrom, based on tissue-specific and/or cell-type specific expression of naturally-occurring miRNAs.

A miRNA, e.g., a natural-occurring miRNA, is a 19-25 nucleotide long noncoding RNA that binds to a polynucleotide and down-regulates gene expression either by reducing stability or by inhibiting translation of the polynucleotide. A miRNA sequence comprises a "seed" region, i.e., a sequence in the region of positions 2-8 of the mature miRNA. A miRNA seed can comprise positions 2-8 or 2-7 of the mature miRNA. In some embodiments, a miRNA seed can comprise 7 nucleotides (e.g., nucleotides 2-8 of the mature miRNA), wherein the seed-complementary site in the corresponding miRNA binding site is flanked by an adenosine (A) opposed to miRNA position 1. In some embodiments, a miRNA seed can comprise 6 nucleotides (e.g., nucleotides 2-7 of the mature miRNA), wherein the seed-complementary site in the corresponding miRNA binding site is flanked by an adenosine (A) opposed to miRNA position 1. See, for example, Grimson A, Farh K K, Johnston W K, Garrett-Engele P, Lim L P, Bartel D P; Mol Cell. 2007 Jul. 6; 27(1):91-105. miRNA profiling of the target cells or tissues can be conducted to determine the presence or absence of miRNA in the cells or tissues. In some embodiments, a polynucleotide (e.g., a ribonucleic acid (RNA), e.g., a messenger RNA (mRNA)) of the invention comprises one or more microRNA binding sites, microRNA target sequences, microRNA complementary sequences, or microRNA seed complementary sequences. Such sequences can correspond to, e.g., have complementarity to, any known microRNA such as those taught in US Publication US2005/0261218 and US Publication US2005/0059005, the contents of each of which are incorporated herein by reference in their entirety.

As used herein, the term "microRNA (miRNA or miR) binding site" refers to a sequence within a polynucleotide, e.g., within a DNA or within an RNA transcript, including in the 5'UTR and/or 3'UTR, that has sufficient complementarity to all or a region of a miRNA to interact with, associate with or bind to the miRNA. In some embodiments, a polynucleotide of the invention comprising an ORF encoding a polypeptide of interest and further comprises one or more miRNA binding site(s). In exemplary embodiments, a 5'UTR and/or 3'UTR of the polynucleotide (e.g., a ribonucleic acid (RNA), e.g., a messenger RNA (mRNA)) comprises the one or more miRNA binding site(s).

A miRNA binding site having sufficient complementarity to a miRNA refers to a degree of complementarity sufficient to facilitate miRNA-mediated regulation of a polynucleotide, e.g., miRNA-mediated translational repression or degradation of the polynucleotide. In exemplary aspects of the invention, a miRNA binding site having sufficient complementarity to the miRNA refers to a degree of complementarity sufficient to facilitate miRNA-mediated degradation of the polynucleotide, e.g., miRNA-guided RNA-induced silencing complex (RISC)-mediated cleavage of mRNA. The miRNA binding site can have complementarity to, for example, a 19-25 nucleotide miRNA sequence, to a 19-23 nucleotide miRNA sequence, or to a 22 nucleotide miRNA sequence. A miRNA binding site can be complementary to only a portion of a miRNA, e.g., to a portion less than 1, 2, 3, or 4 nucleotides of the full length of a naturally-occurring miRNA sequence. Full or complete complementarity (e.g., full complementarity or complete complementarity over all or a significant portion of the length of a naturally-occurring miRNA) is preferred when the desired regulation is mRNA degradation.

In some embodiments, a miRNA binding site includes a sequence that has complementarity (e.g., partial or complete complementarity) with an miRNA seed sequence. In some embodiments, the miRNA binding site includes a sequence that has complete complementarity with a miRNA seed sequence. In some embodiments, a miRNA binding site includes a sequence that has complementarity (e.g., partial or complete complementarity) with an miRNA sequence. In some embodiments, the miRNA binding site includes a sequence that has complete complementarity with a miRNA sequence. In some embodiments, a miRNA binding site has complete complementarity with a miRNA sequence but for 1, 2, or 3 nucleotide substitutions, terminal additions, and/or truncations.

In some embodiments, the miRNA binding site is the same length as the corresponding miRNA. In other embodiments, the miRNA binding site is one, two, three, four, five, six, seven, eight, nine, ten, eleven or twelve nucleotide(s) shorter than the corresponding miRNA at the 5' terminus, the 3' terminus, or both. In still other embodiments, the microRNA binding site is two nucleotides shorter than the corresponding microRNA at the 5' terminus, the 3' terminus, or both. The miRNA binding sites that are shorter than the corresponding miRNAs are still capable of degrading the mRNA incorporating one or more of the miRNA binding sites or preventing the mRNA from translation.

In some embodiments, the miRNA binding site binds the corresponding mature miRNA that is part of an active RISC containing Dicer. In another embodiment, binding of the miRNA binding site to the corresponding miRNA in RISC degrades the mRNA containing the miRNA binding site or prevents the mRNA from being translated. In some embodiments, the miRNA binding site has sufficient complementarity to miRNA so that a RISC complex comprising the miRNA cleaves the polynucleotide comprising the miRNA binding site. In other embodiments, the miRNA binding site has imperfect complementarity so that a RISC complex comprising the miRNA induces instability in the polynucleotide comprising the miRNA binding site. In another embodiment, the miRNA binding site has imperfect complementarity so that a RISC complex comprising the miRNA represses transcription of the polynucleotide comprising the miRNA binding site.

In some embodiments, the miRNA binding site has one, two, three, four, five, six, seven, eight, nine, ten, eleven or twelve mismatch(es) from the corresponding miRNA.

In some embodiments, the miRNA binding site has at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one contiguous nucleotides complementary to at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one, respectively, contiguous nucleotides of the corresponding miRNA.

By engineering one or more miRNA binding sites into a polynucleotide of the invention, the polynucleotide can be targeted for degradation or reduced translation, provided the miRNA in question is available. This can reduce off-target effects upon delivery of the polynucleotide. For example, if a polynucleotide of the invention is not intended to be delivered to a tissue or cell but ends up is said tissue or cell, then a miRNA abundant in the tissue or cell can inhibit the expression of the gene of interest if one or multiple binding sites of the miRNA are engineered into the 5'UTR and/or 3'UTR of the polynucleotide.

Conversely, miRNA binding sites can be removed from polynucleotide sequences in which they naturally occur in order to increase protein expression in specific tissues. For example, a binding site for a specific miRNA can be removed from a polynucleotide to improve protein expression in tissues or cells containing the miRNA.

In one embodiment, a polynucleotide of the invention can include at least one miRNA-binding site in the 5'UTR and/or 3'UTR in order to regulate cytotoxic or cytoprotective mRNA therapeutics to specific cells such as, but not limited to, normal and/or cancerous cells. In another embodiment, a polynucleotide of the invention can include two, three, four, five, six, seven, eight, nine, ten, or more miRNA-binding sites in the 5'-UTR and/or 3'-UTR in order to regulate cytotoxic or cytoprotective mRNA therapeutics to specific cells such as, but not limited to, normal and/or cancerous cells.

Regulation of expression in multiple tissues can be accomplished through introduction or removal of one or more miRNA binding sites, e.g., one or more distinct miRNA binding sites. The decision whether to remove or insert a miRNA binding site can be made based on miRNA expression patterns and/or their profilings in tissues and/or cells in development and/or disease. Identification of miRNAs, miRNA binding sites, and their expression patterns and role in biology have been reported (e.g., Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; Gentner and Naldini, Tissue Antigens. 2012 80:393-403 and all references therein; each of which is incorporated herein by reference in its entirety).

miRNAs and miRNA binding sites can correspond to any known sequence, including non-limiting examples described in U.S. Publication Nos. 2014/0200261, 2005/0261218, and 2005/0059005, each of which are incorporated herein by reference in their entirety.

Examples of tissues where miRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126).

Specifically, miRNAs are known to be differentially expressed in immune cells (also called hematopoietic cells), such as antigen presenting cells (APCs) (e.g., dendritic cells and macrophages), macrophages, monocytes, B lymphocytes, T lymphocytes, granulocytes, natural killer cells, etc. Immune cell specific miRNAs are involved in immunogenicity, autoimmunity, the immune-response to infection, inflammation, as well as unwanted immune response after gene therapy and tissue/organ transplantation. Immune cells specific miRNAs also regulate many aspects of development, proliferation, differentiation and apoptosis of hematopoietic cells (immune cells). For example, miR-142 and miR-146 are exclusively expressed in immune cells, particularly abundant in myeloid dendritic cells. It has been demonstrated that the immune response to a polynucleotide can be shut-off by adding miR-142 binding sites to the 3'-UTR of the polynucleotide, enabling more stable gene transfer in tissues and cells. miR-142 efficiently degrades exogenous polynucleotides in antigen presenting cells and suppresses cytotoxic elimination of transduced cells (e.g., Annoni A et al., blood, 2009, 114, 5152-5161; Brown B D, et al., Nat med. 2006, 12(5), 585-591; Brown B D, et al., blood, 2007, 110(13): 4144-4152, each of which is incorporated herein by reference in its entirety).

An antigen-mediated immune response can refer to an immune response triggered by foreign antigens, which, when entering an organism, are processed by the antigen presenting cells and displayed on the surface of the antigen presenting cells. T cells can recognize the presented antigen and induce a cytotoxic elimination of cells that express the antigen.

Introducing a miR-142 binding site into the 5'UTR and/or 3'UTR of a polynucleotide of the invention can selectively repress gene expression in antigen presenting cells through miR-142 mediated degradation, limiting antigen presentation in antigen presenting cells (e.g., dendritic cells) and thereby preventing antigen-mediated immune response after the delivery of the polynucleotide. The polynucleotide is then stably expressed in target tissues or cells without triggering cytotoxic elimination.

In one embodiment, binding sites for miRNAs that are known to be expressed in immune cells, in particular, antigen presenting cells, can be engineered into a polynucleotide of the invention to suppress the expression of the polynucleotide in antigen presenting cells through miRNA mediated RNA degradation, subduing the antigen-mediated immune response. Expression of the polynucleotide is maintained in non-immune cells where the immune cell specific miRNAs are not expressed. For example, in some embodiments, to prevent an immunogenic reaction against a liver specific protein, any miR-122 binding site can be removed and a miR-142 (and/or mirR-146) binding site can be engineered into the 5'UTR and/or 3'UTR of a polynucleotide of the invention.

To further drive the selective degradation and suppression in APCs and macrophage, a polynucleotide of the invention can include a further negative regulatory element in the 5'UTR and/or 3'UTR, either alone or in combination with miR-142 and/or miR-146 binding sites. As a non-limiting example, the further negative regulatory element is a Constitutive Decay Element (CDE).

Immune cell specific miRNAs include, but are not limited to, hsa-let-7a-2-3p, hsa-let-7a-3p, hsa-7a-5p, hsa-let-7c, hsa-let-7e-3p, hsa-let-7e-5p, hsa-let-7g-3p, hsa-let-7g-5p, hsa-let-7i-3p, hsa-let-7i-5p, miR-10a-3p, miR-10a-5p, miR-1184, hsa-let-7f-1-3p, hsa-let-7f-2-5p, hsa-let-7f-5p, miR-125b-1-3p, miR-125b-2-3p, miR-125b-5p, miR-1279, miR-130a-3p, miR-130a-5p, miR-132-3p, miR-132-5p, miR-142-3p, miR-142-5p, miR-143-3p, miR-143-5p, miR-146a-3p, miR-146a-5p, miR-146b-3p, miR-146b-5p, miR-147a, miR-147b, miR-148a-5p, miR-148a-3p, miR-150-3p, miR-150-5p, miR-151b, miR-155-3p, miR-155-5p, miR-15a-3p, miR-15a-5p, miR-15b-5p, miR-15b-3p, miR-16-1-3p, miR-16-2-3p, miR-16-5p, miR-17-5p, miR-181a-3p, miR-181a-5p, miR-181a-2-3p, miR-182-3p, miR-182-5p, miR-197-3p, miR-197-5p, miR-21-5p, miR-21-3p, miR-214-3p, miR-214-5p, miR-223-3p, miR-223-5p, miR-221-3p, miR-221-5p, miR-23b-3p, miR-23b-5p, miR-24-1-5p, miR-24-2-5p, miR-24-3p, miR-26a-1-3p, miR-26a-2-3p, miR-26a-5p, miR-26b-3p, miR-26b-5p, miR-27a-3p, miR-27a-5p, miR-27b-3p, miR-27b-5p, miR-28-3p, miR-28-5p, miR-2909, miR-29a-3p, miR-29a-5p, miR-29b-1-5p, miR-29b-2-5p, miR-29c-3p, miR-29c-5p, miR-30e-3p, miR-30e-5p, miR-331-5p, miR-339-3p, miR-339-5p, miR-345-3p, miR-345-5p, miR-346, miR-34a-3p, miR-34a-5p, miR-363-3p, miR-363-5p, miR-372, miR-377-3p, miR-377-5p, miR-493-3p, miR-493-5p, miR-542, miR-548b-5p, miR548c-5p, miR-548i, miR-548j, miR-548n, miR-574-3p, miR-598, miR-718, miR-935, miR-99a-3p, miR-99a-5p, miR-99b-3p, and miR-99b-5p. Furthermore, novel miRNAs can be identified in immune cell through micro-array hybridization and microtome analysis (e.g., Jima D D et al, Blood, 2010, 116:e118-e127; Vaz C et al., BMC Genomics, 2010, 11,288, the content of each of which is incorporated herein by reference in its entirety.)

miRNAs that are known to be expressed in the liver include, but are not limited to, miR-107, miR-122-3p, miR-122-5p, miR-1228-3p, miR-1228-5p, miR-1249, miR-129-5p, miR-1303, miR-151a-3p, miR-151a-5p, miR-152, miR-194-3p, miR-194-5p, miR-199a-3p, miR-199a-5p, miR-199b-3p, miR-199b-5p, miR-296-5p, miR-557, miR-581, miR-939-3p, and miR-939-5p. MiRNA binding sites from any liver specific miRNA can be introduced to or removed from a polynucleotide of the invention to regulate expression of the polynucleotide in the liver. Liver specific miRNA binding sites can be engineered alone or further in combination with immune cell (e.g., APC) miRNA binding sites in a polynucleotide of the invention.

miRNAs that are known to be expressed in the lung include, but are not limited to, let-7a-2-3p, let-7a-3p, let-7a-5p, miR-126-3p, miR-126-5p, miR-127-3p, miR-127-5p, miR-130a-3p, miR-130a-5p, miR-130b-3p, miR-130b-5p, miR-133a, miR-133b, miR-134, miR-18a-3p, miR-18a-5p, miR-18b-3p, miR-18b-5p, miR-24-1-5p, miR-24-2-5p, miR-24-3p, miR-296-3p, miR-296-5p, miR-32-3p, miR-337-3p, miR-337-5p, miR-381-3p, and miR-381-5p. miRNA binding sites from any lung specific miRNA can be introduced to or removed from a polynucleotide of the invention to regulate expression of the polynucleotide in the lung. Lung specific miRNA binding sites can be engineered alone or further in combination with immune cell (e.g., APC) miRNA binding sites in a polynucleotide of the invention.

miRNAs that are known to be expressed in the heart include, but are not limited to, miR-1, miR-133a, miR-133b, miR-149-3p, miR-149-5p, miR-186-3p, miR-186-5p, miR-208a, miR-208b, miR-210, miR-296-3p, miR-320, miR-451a, miR-451b, miR-499a-3p, miR-499a-5p, miR-499b-3p, miR-499b-5p, miR-744-3p, miR-744-5p, miR-92b-3p, and miR-92b-5p. mMiRNA binding sites from any heart specific microRNA can be introduced to or removed from a polynucleotide of the invention to regulate expression of the polynucleotide in the heart. Heart specific miRNA binding sites can be engineered alone or further in combination with immune cell (e.g., APC) miRNA binding sites in a polynucleotide of the invention.

miRNAs that are known to be expressed in the nervous system include, but are not limited to, miR-124-5p, miR-125a-3p, miR-125a-5p, miR-125b-1-3p, miR-125b-2-3p, miR-125b-5p, miR-1271-3p, miR-1271-5p, miR-128, miR-132-5p, miR-135a-3p, miR-135a-5p, miR-135b-3p, miR-135b-5p, miR-137, miR-139-5p, miR-139-3p, miR-149-3p, miR-149-5p, miR-153, miR-181c-3p, miR-181c-5p, miR-183-3p, miR-183-5p, miR-190a, miR-190b, miR-212-3p, miR-212-5p, miR-219-1-3p, miR-219-2-3p, miR-23a-3p, miR-23a-5p, miR-30a-5p, miR-30b-3p, miR-30b-5p, miR-30c-1-3p, miR-30c-2-3p, miR-30c-5p, miR-30d-3p, miR-30d-5p, miR-329, miR-342-3p, miR-3665, miR-3666, miR-380-3p, miR-380-5p, miR-383, miR-410, miR-425-3p, miR-425-5p, miR-454-3p, miR-454-5p, miR-483, miR-510, miR-516a-3p, miR-548b-5p, miR-548c-5p, miR-571, miR-7-1-3p, miR-7-2-3p, miR-7-5p, miR-802, miR-922, miR-9-3p, and miR-9-5p. miRNAs enriched in the nervous system further include those specifically expressed in neurons, including, but not limited to, miR-132-3p, miR-132-3p, miR-148b-3p, miR-148b-5p, miR-151a-3p, miR-151a-5p, miR-212-3p, miR-212-5p, miR-320b, miR-320e, miR-323a-3p, miR-323a-5p, miR-324-5p, miR-325, miR-326, miR-328, miR-922 and those specifically expressed in glial cells, including, but not limited to, miR-1250, miR-219-1-3p, miR-219-2-3p, miR-219-5p, miR-23a-3p, miR-23a-5p, miR-3065-3p, miR-3065-5p, miR-30e-3p, miR-30e-5p, miR-32-5p, miR-338-5p, and miR-657. miRNA binding sites from any CNS specific miRNA can be introduced to or removed from a polynucleotide of the invention to regulate expression of the polynucleotide in the nervous system. Nervous system specific miRNA binding sites can be engineered alone or further in combination with immune cell (e.g., APC) miRNA binding sites in a polynucleotide of the invention.

miRNAs that are known to be expressed in the pancreas include, but are not limited to, miR-105-3p, miR-105-5p, miR-184, miR-195-3p, miR-195-5p, miR-196a-3p, miR-196a-5p, miR-214-3p, miR-214-5p, miR-216a-3p, miR-216a-5p, miR-30a-3p, miR-33a-3p, miR-33a-5p, miR-375, miR-7-1-3p, miR-7-2-3p, miR-493-3p, miR-493-5p, and miR-944. MiRNA binding sites from any pancreas specific miRNA can be introduced to or removed from a polynucleotide of the invention to regulate expression of the polynucleotide in the pancreas. Pancreas specific miRNA binding sites can be engineered alone or further in combination with immune cell (e.g. APC) miRNA binding sites in a polynucleotide of the invention.

miRNAs that are known to be expressed in the kidney include, but are not limited to, miR-122-3p, miR-145-5p, miR-17-5p, miR-192-3p, miR-192-5p, miR-194-3p, miR-194-5p, miR-20a-3p, miR-20a-5p, miR-204-3p, miR-204-5p, miR-210, miR-216a-3p, miR-216a-5p, miR-296-3p, miR-30a-3p, miR-30a-5p, miR-30b-3p, miR-30b-5p, miR-30c-1-3p, miR-30c-2-3p, miR30c-5p, miR-324-3p, miR-335-3p, miR-335-5p, miR-363-3p, miR-363-5p, and miR-562. miRNA binding sites from any kidney specific miRNA can be introduced to or removed from a polynucleotide of the invention to regulate expression of the polynucleotide in the kidney. Kidney specific miRNA binding sites can be engineered alone or further in combination with immune cell (e.g., APC) miRNA binding sites in a polynucleotide of the invention.

miRNAs that are known to be expressed in the muscle include, but are not limited to, let-7g-3p, let-7g-5p, miR-1, miR-1286, miR-133a, miR-133b, miR-140-3p, miR-143-3p, miR-143-5p, miR-145-3p, miR-145-5p, miR-188-3p, miR-188-5p, miR-206, miR-208a, miR-208b, miR-25-3p, and miR-25-5p. MiRNA binding sites from any muscle specific miRNA can be introduced to or removed from a polynucleotide of the invention to regulate expression of the polynucleotide in the muscle. Muscle specific miRNA binding sites can be engineered alone or further in combination with immune cell (e.g., APC) miRNA binding sites in a polynucleotide of the invention.

miRNAs are also differentially expressed in different types of cells, such as, but not limited to, endothelial cells, epithelial cells, and adipocytes.

miRNAs that are known to be expressed in endothelial cells include, but are not limited to, let-7b-3p, let-7b-5p, miR-100-3p, miR-100-5p, miR-101-3p, miR-101-5p, miR-126-3p, miR-126-5p, miR-1236-3p, miR-1236-5p, miR-130a-3p, miR-130a-5p, miR-17-5p, miR-17-3p, miR-18a-3p, miR-18a-5p, miR-19a-3p, miR-19a-5p, miR-19b-1-5p, miR-19b-2-5p, miR-19b-3p, miR-20a-3p, miR-20a-5p, miR-217, miR-210, miR-21-3p, miR-21-5p, miR-221-3p, miR-221-5p, miR-222-3p, miR-222-5p, miR-23a-3p, miR-23a-5p, miR-296-5p, miR-361-3p, miR-361-5p, miR-421, miR-424-3p, miR-424-5p, miR-513a-5p, miR-92a-1-5p, miR-92a-2-5p, miR-92a-3p, miR-92b-3p, and miR-92b-5p. Many novel miRNAs are discovered in endothelial cells from deep-sequencing analysis (e.g., Voellenkle C et al., RNA, 2012, 18, 472-484, herein incorporated by reference in its entirety). miRNA binding sites from any endothelial cell specific miRNA can be introduced to or removed from a polynucleotide of the invention to regulate expression of the polynucleotide in the endothelial cells.

miRNAs that are known to be expressed in epithelial cells include, but are not limited to, let-7b-3p, let-7b-5p, miR-1246, miR-200a-3p, miR-200a-5p, miR-200b-3p, miR-200b-5p, miR-200c-3p, miR-200c-5p, miR-338-3p, miR-429, miR-451a, miR-451b, miR-494, miR-802 and miR-34a, miR-34b-5p, miR-34c-5p, miR-449a, miR-449b-3p, miR-449b-5p specific in respiratory ciliated epithelial cells, let-7 family, miR-133a, miR-133b, miR-126 specific in lung epithelial cells, miR-382-3p, miR-382-5p specific in renal epithelial cells, and miR-762 specific in corneal epithelial cells. miRNA binding sites from any epithelial cell specific miRNA can be introduced to or removed from a polynucleotide of the invention to regulate expression of the polynucleotide in the epithelial cells.

In addition, a large group of miRNAs are enriched in embryonic stem cells, controlling stem cell self-renewal as well as the development and/or differentiation of various cell lineages, such as neural cells, cardiac, hematopoietic cells, skin cells, osteogenic cells and muscle cells (e.g., Kuppusamy K T et al., Curr. Mol Med, 2013, 13(5), 757-764; Vidigal J A and Ventura A, Semin Cancer Biol. 2012, 22(5-6), 428-436; Goff L A et al., PLoS One, 2009, 4:e7192; Morin R D et al., Genome Res, 2008, 18, 610-621; Yoo J K et al., Stem Cells Dev. 2012, 21(11), 2049-2057, each of which is herein incorporated by reference in its entirety). MiRNAs abundant in embryonic stem cells include, but are not limited to, let-7a-2-3p, let-a-3p, let-7a-5p, let7d-3p, let-7d-5p, miR-103a-2-3p, miR-103a-5p, miR-106b-3p, miR-106b-5p, miR-1246, miR-1275, miR-138-1-3p, miR-138-2-3p, miR-138-5p, miR-154-3p, miR-154-5p, miR-200c-3p, miR-200c-5p, miR-290, miR-301a-3p, miR-301a-5p, miR-302a-3p, miR-302a-5p, miR-302b-3p, miR-302b-5p, miR-302c-3p, miR-302c-5p, miR-302d-3p, miR-302d-5p, miR-302e, miR-367-3p, miR-367-5p, miR-369-3p, miR-369-5p, miR-370, miR-371, miR-373, miR-380-5p, miR-423-3p, miR-423-5p, miR-486-5p, miR-520c-3p, miR-548e, miR-548f, miR-548g-3p, miR-548g-5p, miR-548i, miR-548k, miR-548l, miR-548m, miR-548n, miR-548o-3p, miR-548o-5p, miR-548p, miR-664a-3p, miR-664a-5p, miR-664b-3p, miR-664b-5p, miR-766-3p, miR-766-5p, miR-885-3p, miR-885-5p, miR-93-3p, miR-93-5p, miR-941, miR-96-3p, miR-96-5p, miR-99b-3p and miR-99b-5p. Many predicted novel miRNAs are discovered by deep sequencing in human embryonic stem cells (e.g., Morin R D et al., Genome Res, 2008, 18, 610-621; Goff L A et al., PLoS One, 2009, 4:e7192; Bar M et al., Stem cells, 2008, 26, 2496-2505, the content of each of which is incorporated herein by reference in its entirety).

In one embodiment, the binding sites of embryonic stem cell specific miRNAs can be included in or removed from the 3'UTR of a polynucleotide of the invention to modulate the development and/or differentiation of embryonic stem cells, to inhibit the senescence of stem cells in a degenerative condition (e.g. degenerative diseases), or to stimulate the senescence and apoptosis of stem cells in a disease condition (e.g. cancer stem cells).

As a non-limiting example, miRNA binding sites for miRNAs that are over-expressed in certain cancer and/or tumor cells can be removed from the 3'UTR of a polynucleotide of the invention, restoring the expression suppressed by the over-expressed miRNAs in cancer cells, thus ameliorating the corresponsive biological function, for instance, transcription stimulation and/or repression, cell cycle arrest, apoptosis and cell death. Normal cells and tissues, wherein miRNAs expression is not up-regulated, will remain unaffected.

miRNA can also regulate complex biological processes such as angiogenesis (e.g., miR-132) (Anand and Cheresh Curr Opin Hematol 2011 18:171-176). In the polynucleotides of the invention, miRNA binding sites that are involved in such processes can be removed or introduced, in order to tailor the expression of the polynucleotides to biologically relevant cell types or relevant biological processes. In this context, the polynucleotides of the invention are defined as auxotrophic polynucleotides.

In some embodiments, a polynucleotide of the invention comprises a miRNA binding site, wherein the miRNA binding site comprises one or more nucleotide sequences selected from TABLE 4, including one or more copies of any one or more of the miRNA binding site sequences. In some embodiments, a polynucleotide of the invention further comprises at least one, two, three, four, five, six, seven, eight, nine, ten, or more of the same or different miRNA binding sites selected from TABLE 4, including any combination thereof. In some embodiments, the miRNA binding site binds to miR-142 or is complementary to miR-142. In some embodiments, the miR-142 comprises SEQ ID NO:539. In some embodiments, the miRNA binding site binds to miR-142-3p or miR-142-5p. In some embodiments, the miR-142-3p binding site comprises SEQ ID NO:541. In some embodiments, the miR-142-5p binding site comprises SEQ ID NO:543. In some embodiments, the miRNA binding site comprises a nucleotide sequence at least 80%, at least 85%, at least 90%, at least 95%, or 100% identical to SEQ ID NO:541 or SEQ ID NO:543.

TABLE 4 miR-142 and alternative miR-142 binding sites

| SEQ ID NO. | Description | Sequence |
|---|---|---|
| 539 | miR-142 | GACAGUGCAGUCACCCAUAAAGUAGAAAGCA UACUAACAGCACUGGAGGGUGUAGUGUUCC UACUUUAUGGAUGAGUGUACUGUG |
| 540 | miR-142-3p | UGUAGUGUUUCCUACUUUAUGGA |
| 541 | miR-142-3p binding site | UCCAUAAAGUAGGAAACACUACA |
| 542 | miR-142-5p | CAUAAAGUAGAAAGCACUACU |
| 543 | miR-142-5p binding site | AGUAGUGCUUUCUACUUUAUG |

In some embodiments, a miRNA binding site is inserted in the polynucleotide of the invention in any position of the polynucleotide (e.g., the 5'UTR and/or 3'UTR). In some embodiments, the 5'UTR comprises a miRNA binding site. In some embodiments, the 3'UTR comprises a miRNA binding site. In some embodiments, the 5'UTR and the 3'UTR comprise a miRNA binding site. The insertion site in the polynucleotide can be anywhere in the polynucleotide as long as the insertion of the miRNA binding site in the polynucleotide does not interfere with the translation of a functional polypeptide in the absence of the corresponding miRNA; and in the presence of the miRNA, the insertion of the miRNA binding site in the polynucleotide and the binding of the miRNA binding site to the corresponding miRNA are capable of degrading the polynucleotide or preventing the translation of the polynucleotide.

In some embodiments, a miRNA binding site is inserted in at least about 30 nucleotides downstream from the stop codon of an ORF in a polynucleotide of the invention comprising the ORF. In some embodiments, a miRNA binding site is inserted in at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides downstream from the stop codon of an ORF in a polynucleotide of the invention. In some embodiments, a miRNA binding site is inserted in about 10 nucleotides to about 100 nucleotides, about 20 nucleotides to about 90 nucleotides, about 30 nucleotides to about 80 nucleotides, about 40 nucleotides to about 70 nucleotides, about 50 nucleotides to about 60 nucleotides, about 45 nucleotides to about 65 nucleotides downstream from the stop codon of an ORF in a polynucleotide of the invention.

miRNA gene regulation can be influenced by the sequence surrounding the miRNA such as, but not limited to, the species of the surrounding sequence, the type of sequence (e.g., heterologous, homologous, exogenous, endogenous, or artificial), regulatory elements in the surrounding sequence and/or structural elements in the surrounding sequence. The miRNA can be influenced by the 5'UTR and/or 3'UTR. As a non-limiting example, a non-human 3'UTR can increase the regulatory effect of the miRNA sequence on the expression of a polypeptide of interest compared to a human 3'UTR of the same sequence type.

In one embodiment, other regulatory elements and/or structural elements of the 5'UTR can influence miRNA mediated gene regulation. One example of a regulatory element and/or structural element is a structured IRES (Internal Ribosome Entry Site) in the 5'UTR, which is necessary for the binding of translational elongation factors to initiate protein translation. EIF4A2 binding to this secondarily structured element in the 5'-UTR is necessary for miRNA mediated gene expression (Meijer H A et al., Science, 2013, 340, 82-85, herein incorporated by reference in its entirety). The polynucleotides of the invention can further include this structured 5'UTR in order to enhance microRNA mediated gene regulation.

At least one miRNA binding site can be engineered into the 3'UTR of a polynucleotide of the invention. In this context, at least two, at least three, at least four, at least five, at least six, at least seven, at least eight, at least nine, at least ten, or more miRNA binding sites can be engineered into a 3'UTR of a polynucleotide of the invention. For example, 1 to 10, 1 to 9, 1 to 8, 1 to 7, 1 to 6, 1 to 5, 1 to 4, 1 to 3, 2, or 1 miRNA binding sites can be engineered into the 3'UTR of a polynucleotide of the invention. In one embodiment, miRNA binding sites incorporated into a polynucleotide of the invention can be the same or can be different miRNA sites. A combination of different miRNA binding sites incorporated into a polynucleotide of the invention can include combinations in which more than one copy of any of the different miRNA sites are incorporated. In another embodiment, miRNA binding sites incorporated into a polynucleotide of the invention can target the same or different tissues in the body. As a non-limiting example, through the introduction of tissue-, cell-type-, or disease-specific miRNA binding sites in the 3'-UTR of a polynucleotide of the invention, the degree of expression in specific cell types (e.g., hepatocytes, myeloid cells, endothelial cells, cancer cells, etc.) can be reduced.

In one embodiment, a miRNA binding site can be engineered near the 5' terminus of the 3'UTR, about halfway between the 5' terminus and 3' terminus of the 3'UTR and/or near the 3' terminus of the 3'UTR in a polynucleotide of the invention. As a non-limiting example, a miRNA binding site can be engineered near the 5' terminus of the 3'UTR and about halfway between the 5' terminus and 3' terminus of the 3'UTR. As another non-limiting example, a miRNA binding site can be engineered near the 3' terminus of the 3'UTR and about halfway between the 5' terminus and 3' terminus of the 3'UTR. As yet another non-limiting example, a miRNA binding site can be engineered near the 5' terminus of the 3'UTR and near the 3' terminus of the 3'UTR.

In another embodiment, a 3'UTR can comprise 1, 2, 3, 4, 5, 6, 7, 8, 9, or 10 miRNA binding sites. The miRNA binding sites can be complementary to a miRNA, miRNA seed sequence, and/or miRNA sequences flanking the seed sequence.

In one embodiment, a polynucleotide of the invention can be engineered to include more than one miRNA site expressed in different tissues or different cell types of a subject. As a non-limiting example, a polynucleotide of the invention can be engineered to include miR-192 and miR-122 to regulate expression of the polynucleotide in the liver and kidneys of a subject. In another embodiment, a polynucleotide of the invention can be engineered to include more than one miRNA site for the same tissue.

In some embodiments, the expression of a polynucleotide of the invention can be controlled by incorporating at least one miR binding site in the polynucleotide and formulating the polynucleotide for administration. As a non-limiting example, a polynucleotide of the invention can be targeted to a tissue or cell by incorporating a miRNA binding site and formulating the polynucleotide in a lipid nanoparticle comprising a ionizable lipid, including any of the lipids described herein.

A polynucleotide of the invention can be engineered for more targeted expression in specific tissues, cell types, or biological conditions based on the expression patterns of miRNAs in the different tissues, cell types, or biological conditions. Through introduction of tissue-specific miRNA binding sites, a polynucleotide of the invention can be designed for optimal protein expression in a tissue or cell, or in the context of a biological condition.

In some embodiments, a polynucleotide of the invention can be designed to incorporate miRNA binding sites that either have 100% identity to known miRNA seed sequences or have less than 100% identity to miRNA seed sequences. In some embodiments, a polynucleotide of the invention can be designed to incorporate miRNA binding sites that have at least: 60%, 65%, 70%, 75%, 80%, 85%, 90%, 95%, 96%, 97%, 98%, or 99% identity to known miRNA seed sequences. The miRNA seed sequence can be partially mutated to decrease miRNA binding affinity and as such result in reduced downmodulation of the polynucleotide. In essence, the degree of match or mis-match between the miRNA binding site and the miRNA seed can act as a rheostat to more finely tune the ability of the miRNA to modulate protein expression. In addition, mutation in the non-seed region of a miRNA binding site can also impact the ability of a miRNA to modulate protein expression.

In one embodiment, a miRNA sequence can be incorporated into the loop of a stem loop.

In another embodiment, a miRNA seed sequence can be incorporated in the loop of a stem loop and a miRNA binding site can be incorporated into the 5' or 3' stem of the stem loop.

In one embodiment, a translation enhancer element (TEE) can be incorporated on the 5' end of the stem of a stem loop and a miRNA seed can be incorporated into the stem of the stem loop. In another embodiment, a TEE can be incorporated on the 5' end of the stem of a stem loop, a miRNA seed can be incorporated into the stem of the stem loop and a miRNA binding site can be incorporated into the 3' end of the stem or the sequence after the stem loop. The miRNA seed and the miRNA binding site can be for the same and/or different miRNA sequences.

In one embodiment, the incorporation of a miRNA sequence and/or a TEE sequence changes the shape of the stem loop region which can increase and/or decrease translation. (see e.g, Kedde et al., "A Pumilio-induced RNA structure switch in p27-3'UTR controls miR-221 and miR-22 accessibility." Nature Cell Biology. 2010, incorporated herein by reference in its entirety).

In one embodiment, the 5'-UTR of a polynucleotide of the invention can comprise at least one miRNA sequence. The miRNA sequence can be, but is not limited to, a 19 or 22 nucleotide sequence and/or a miRNA sequence without the seed.

In one embodiment the miRNA sequence in the 5'UTR can be used to stabilize a polynucleotide of the invention described herein.

In another embodiment, a miRNA sequence in the 5'UTR of a polynucleotide of the invention can be used to decrease the accessibility of the site of translation initiation such as, but not limited to a start codon. See, e.g., Matsuda et al., PLoS One. 2010 11(5):e15057; incorporated herein by reference in its entirety, which used antisense locked nucleic acid (LNA) oligonucleotides and exon-junction complexes (EJCs) around a start codon (−4 to +37 where the A of the AUG codons is +1) in order to decrease the accessibility to the first start codon (AUG). Matsuda showed that altering the sequence around the start codon with an LNA or EJC affected the efficiency, length and structural stability of a polynucleotide. A polynucleotide of the invention can comprise a miRNA sequence, instead of the LNA or EJC sequence described by Matsuda et al, near the site of translation initiation in order to decrease the accessibility to the site of translation initiation. The site of translation initiation can be prior to, after or within the miRNA sequence. As a non-limiting example, the site of translation initiation can be located within a miRNA sequence such as a seed sequence or binding site. As another non-limiting example, the site of translation initiation can be located within a miR-122 sequence such as the seed sequence or the mir-122 binding site.

In some embodiments, a polynucleotide of the invention can include at least one miRNA in order to dampen the antigen presentation by antigen presenting cells. The miRNA can be the complete miRNA sequence, the miRNA seed sequence, the miRNA sequence without the seed, or a combination thereof. As a non-limiting example, a miRNA incorporated into a polynucleotide of the invention can be specific to the hematopoietic system. As another non-limiting example, a miRNA incorporated into a polynucleotide of the invention to dampen antigen presentation is miR-142-3p.

In some embodiments, a polynucleotide of the invention can include at least one miRNA in order to dampen expression of the encoded polypeptide in a tissue or cell of interest. As a non-limiting example, a polynucleotide of the invention can include at least one miR-122 binding site in order to dampen expression of an encoded polypeptide of interest in the liver. As another non-limiting example a polynucleotide of the invention can include at least one miR-142-3p binding site, miR-142-3p seed sequence, miR-142-3p binding site without the seed, miR-142-5p binding site, miR-142-5p seed sequence, miR-142-5p binding site without the seed, miR-146 binding site, miR-146 seed sequence and/or miR-146 binding site without the seed sequence.

In some embodiments, a polynucleotide of the invention can comprise at least one miRNA binding site in the 3'UTR in order to selectively degrade mRNA therapeutics in the immune cells to subdue unwanted immunogenic reactions caused by therapeutic delivery. As a non-limiting example, the miRNA binding site can make a polynucleotide of the invention more unstable in antigen presenting cells. Non-limiting examples of these miRNAs include mir-142-5p, mir-142-3p, mir-146a-5p, and mir-146-3p.

In one embodiment, a polynucleotide of the invention comprises at least one miRNA sequence in a region of the polynucleotide that can interact with a RNA binding protein.

In some embodiments, the polynucleotide of the invention (e.g., a RNA, e.g., an mRNA) comprising (i) a sequence-optimized nucleotide sequence (e.g., an ORF) encoding a wild type relaxin polypeptide and (ii) a miRNA binding site (e.g., a miRNA binding site that binds to miR-142).

In some embodiments, the polynucleotide of the invention comprises a uracil-modified sequence encoding a relaxin polypeptide disclosed herein and a miRNA binding site disclosed herein, e.g., a miRNA binding site that binds to miR-142. In some embodiments, the uracil-modified sequence encoding a relaxin polypeptide comprises at least one chemically modified nucleobase, e.g., 5-methoxyuracil. In some embodiments, at least 95% of a type of nucleobase (e.g., uricil) in a uracil-modified sequence encoding a relaxin polypeptide of the invention are modified nucleobases. In some embodiments, at least 95% of uricil in a uracil-modified sequence encoding a relaxin polypeptide is 5-methoxyuridine. In some embodiments, the polynucleotide comprising a nucleotide sequence encoding a relaxin polypeptide disclosed herein and a miRNA binding site is formulated with a delivery agent, e.g., a LNP comprising, for instance, a lipid having the Formula (I), (IA), (II), (IIa), (IIb), (IIc), (IId) or (IIe), e.g., any of Compounds 1-232.

3' UTRs

In certain embodiments, a polynucleotide of the present invention (e.g., a polynucleotide comprising a nucleotide sequence encoding a relaxin polypeptide of the invention) further comprises a 3' UTR.

3'-UTR is the section of mRNA that immediately follows the translation termination codon and often contains regulatory regions that post-transcriptionally influence gene expression. Regulatory regions within the 3'-UTR can influence polyadenylation, translation efficiency, localization, and stability of the mRNA. In one embodiment, the 3'-UTR useful for the invention comprises a binding site for regulatory proteins or microRNAs.

Regions Having a 5' Cap

The invention also includes a polynucleotide that comprises both a 5' Cap and a polynucleotide of the present invention (e.g., a polynucleotide comprising a nucleotide sequence encoding a relaxin polypeptide).

The 5' cap structure of a natural mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns during mRNA splicing.

Endogenous mRNA molecules can be 5'-end capped generating a 5'-ppp-5'-triphosphate linkage between a terminal guanosine cap residue and the 5'-terminal transcribed sense nucleotide of the mRNA molecule. This 5'-guanylate cap can then be methylated to generate an N7-methyl-guanylate residue. The ribose sugars of the terminal and/or anteterminal transcribed nucleotides of the 5' end of the mRNA can optionally also be 2'-O-methylated. 5'-decapping through hydrolysis and cleavage of the guanylate cap structure can target a nucleic acid molecule, such as an mRNA molecule, for degradation.

In some embodiments, the polynucleotides of the present invention (e.g., a polynucleotide comprising a nucleotide sequence encoding a relaxin polypeptide) incorporate a cap moiety.

In some embodiments, polynucleotides of the present invention (e.g., a polynucleotide comprising a nucleotide sequence encoding a relaxin polypeptide) comprise a non-hydrolyzable cap structure preventing decapping and thus increasing mRNA half-life. Because cap structure hydrolysis requires cleavage of 5'-ppp-5' phosphorodiester linkages, modified nucleotides can be used during the capping reaction. For example, a Vaccinia Capping Enzyme from New England Biolabs (Ipswich, Mass.) can be used with α-thio-guanosine nucleotides according to the manufacturer's instructions to create a phosphorothioate linkage in the 5'-ppp-5' cap. Additional modified guanosine nucleotides can be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide that functions as an mRNA molecule. Cap analogs, which herein are also referred to as synthetic cap analogs, chemical caps, chemical cap analogs, or structural or functional cap analogs, differ from natural (i.e., endogenous, wild-type or physiological) 5'-caps in their chemical structure, while retaining cap function. Cap analogs can be chemically (i.e., non-enzymatically) or enzymatically synthesized and/or linked to the polynucleotides of the invention.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3'mppp-G; which can equivalently be designated 3' O-Me-m7G(5')ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, m$^7$Gm-ppp-G).

In some embodiments, the cap is a dinucleotide cap analog. As a non-limiting example, the dinucleotide cap analog can be modified at different phosphate positions with a boranophosphate group or a phophoroselenoate group such as the dinucleotide cap analogs described in U.S. Pat. No. 8,519,110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dicucleotide form of a cap analog include a N7-(4-chlorophenoxyethyl)-G(5')ppp(5')G and a N7-(4-chlorophenoxyethyl)-m$^{3'\text{-}O}$G(5')ppp(5')G cap analog (See, e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present invention is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, can lead to reduced translational competency and reduced cellular stability.

Polynucleotides of the invention (e.g., a polynucleotide comprising a nucleotide sequence encoding a relaxin polypeptide) can also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present invention are those that, among other things, have enhanced binding of cap binding proteins, increased half-life, reduced susceptibility to 5' endonucleases and/or reduced 5' decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5')ppp(5')N, pN2p (cap 0), 7mG(5')ppp(5')N1mpNp (cap 1), and 7mG(5')-ppp(5')N1mpN2mp (cap 2).

As a non-limiting example, capping chimeric polynucleotides post-manufacture can be more efficient as nearly 100% of the chimeric polynucleotides can be capped. This is in contrast to ~80% when a cap analog is linked to a chimeric polynucleotide in the course of an in vitro transcription reaction.

According to the present invention, 5' terminal caps can include endogenous caps or cap analogs. According to the present invention, a 5' terminal cap can comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

Poly-A Tails

In some embodiments, the polynucleotides of the present disclosure (e.g., a polynucleotide comprising a nucleotide sequence encoding a relaxin polypeptide) further comprise a poly-A tail. In further embodiments, terminal groups on the poly-A tail can be incorporated for stabilization. In other embodiments, a poly-A tail comprises des-3' hydroxyl tails.

During RNA processing, a long chain of adenine nucleotides (poly-A tail) can be added to a polynucleotide such as an mRNA molecule in order to increase stability. Immediately after transcription, the 3' end of the transcript can be cleaved to free a 3' hydroxyl. Then poly-A polymerase adds a chain of adenine nucleotides to the RNA. The process, called polyadenylation, adds a poly-A tail that can be between, for example, approximately 80 to approximately 250 residues long, including approximately 80, 90, 100, 110, 120, 130, 140, 150, 160, 170, 180, 190, 200, 210, 220, 230, 240 or 250 residues long.

PolyA tails can also be added after the construct is exported from the nucleus.

According to the present invention, terminal groups on the poly A tail can be incorporated for stabilization. Polynucleotides of the present invention can include des-3' hydroxyl tails. They can also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present invention can be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present invention. Generally, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides).

In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In some embodiments, the poly-A tail is designed relative to the length of the overall polynucleotide or the length of a particular region of the polynucleotide. This design can be based on the length of a coding region, the length of a particular feature or region or based on the length of the ultimate product expressed from the polynucleotides.

In this context, the poly-A tail can be 10, 20, 30, 40, 50, 60, 70, 80, 90, or 100% greater in length than the polynucleotide or feature thereof. The poly-A tail can also be designed as a fraction of the polynucleotides to which it belongs. In this context, the poly-A tail can be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein can enhance expression.

Additionally, multiple distinct polynucleotides can be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In some embodiments, the polynucleotides of the present invention are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

Start Codon Region

The invention also includes a polynucleotide that comprises both a start codon region and the polynucleotide described herein (e.g., a polynucleotide comprising a nucleotide sequence encoding a relaxin polypeptide). In some embodiments, the polynucleotides of the present invention can have regions that are analogous to or function like a start codon region.

In some embodiments, the translation of a polynucleotide can initiate on a codon that is not the start codon AUG. Translation of the polynucleotide can initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety).

As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See, e.g., Matsuda and Mauro PLoS ONE, 2010 5:11; the contents of which are herein incorporated by reference in its entirety). Masking any of the nucleotides flanking a codon that initiates translation can be used to alter the position of translation initiation, translation efficiency, length and/or structure of a polynucleotide.

In some embodiments, a masking agent can be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs) (See, e.g., Matsuda and Mauro describing masking agents LNA polynucleotides and EJCs (PLoS ONE, 2010 5:11); the contents of which are herein incorporated by reference in its entirety).

In another embodiment, a masking agent can be used to mask a start codon of a polynucleotide in order to increase the likelihood that translation will initiate on an alternative start codon. In some embodiments, a masking agent can be used to mask a first start codon or alternative start codon in order to increase the chance that translation will initiate on a start codon or alternative start codon downstream to the masked start codon or alternative start codon.

In some embodiments, a start codon or alternative start codon can be located within a perfect complement for a miR binding site. The perfect complement of a miR binding site can help control the translation, length and/or structure of the polynucleotide similar to a masking agent. As a non-limiting example, the start codon or alternative start codon can be located in the middle of a perfect complement for a miRNA binding site. The start codon or alternative start codon can be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide can be removed from the polynucleotide sequence in order to have the translation of the polynucleotide begin on a codon that is not the start codon. Translation of the polynucleotide can begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed can further comprise at least one masking agent for the downstream start codon and/or alternative start codons in order to control or attempt to control the initiation of translation, the length of the polynucleotide and/or structure of the polynucleotide.

Stop Codon Region

The invention also includes a polynucleotide that comprises both a stop codon region and the polynucleotide described herein (e.g., a polynucleotide comprising a nucleotide sequence encoding a relaxin polypeptide). In some embodiments, the polynucleotides of the present invention can include at least two stop codons before the 3' untranslated region (UTR). The stop codon can be selected from TGA, TAA and TAG in the case of DNA, or from UGA, UAA and UAG in the case of RNA. In some embodiments, the polynucleotides of the present invention include the stop codon TGA in the case or DNA, or the stop codon UGA in the case of RNA, and one additional stop codon. In a further embodiment the addition stop codon can be TAA or UAA. In another embodiment, the polynucleotides of the present invention include three consecutive stop codons, four stop codons, or more.

Insertions and Substitutions

The invention also includes a polynucleotide of the present disclosure that further comprises insertions and/or substitutions.

In some embodiments, the 5'UTR of the polynucleotide can be replaced by the insertion of at least one region and/or string of nucleosides of the same base. The region and/or string of nucleotides can include, but is not limited to, at least 3, at least 4, at least 5, at least 6, at least 7 or at least 8 nucleotides and the nucleotides can be natural and/or unnatural. As a non-limiting example, the group of nucleotides can include 5-8 adenine, cytosine, thymine, a string of any of the other nucleotides disclosed herein and/or combinations thereof.

In some embodiments, the 5'UTR of the polynucleotide can be replaced by the insertion of at least two regions and/or strings of nucleotides of two different bases such as, but not limited to, adenine, cytosine, thymine, any of the other nucleotides disclosed herein and/or combinations thereof. For example, the 5'UTR can be replaced by inserting 5-8 adenine bases followed by the insertion of 5-8 cytosine bases. In another example, the 5'UTR can be replaced by inserting 5-8 cytosine bases followed by the insertion of 5-8 adenine bases.

In some embodiments, the polynucleotide can include at least one substitution and/or insertion downstream of the transcription start site that can be recognized by an RNA polymerase. As a non-limiting example, at least one substitution and/or insertion can occur downstream of the transcription start site by substituting at least one nucleic acid in the region just downstream of the transcription start site (such as, but not limited to, +1 to +6). Changes to region of nucleotides just downstream of the transcription start site can affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside can cause a silent mutation of the sequence or can cause a mutation in the amino acid sequence.

In some embodiments, the polynucleotide can include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In some embodiments, the polynucleotide can include the substitution of at least 1, at least 2, at least 3, at least 4, at least 5 or at least 6 guanine bases in the region just downstream of the transcription start site. As a non-limiting example, if the nucleotides in the region are GGGAGA, the guanine bases can be substituted by at least 1, at least 2, at least 3 or at least 4 adenine nucleotides. In another non-limiting example, if the nucleotides in the region are GGGAGA the guanine bases can be substituted by at least 1, at least 2, at least 3 or at least 4 cytosine bases. In another non-limiting example, if the nucleotides in the region are GGGAGA the guanine bases can be substituted by at least 1, at least 2, at least 3 or at least 4 thymine, and/or any of the nucleotides described herein.

In some embodiments, the polynucleotide can include at least one substitution and/or insertion upstream of the start codon. For the purpose of clarity, one of skill in the art would appreciate that the start codon is the first codon of the protein coding region whereas the transcription start site is the site where transcription begins. The polynucleotide can include, but is not limited to, at least 1, at least 2, at least 3, at least 4, at least 5, at least 6, at least 7 or at least 8 substitutions and/or insertions of nucleotide bases. The nucleotide bases can be inserted or substituted at 1, at least 1, at least 2, at least 3, at least 4 or at least 5 locations upstream of the start codon. The nucleotides inserted and/or substituted can be the same base (e.g., all A or all C or all T or all G), two different bases (e.g., A and C, A and T, or C and T), three different bases (e.g., A, C and T or A, C and T) or at least four different bases.

As a non-limiting example, the guanine base upstream of the coding region in the polynucleotide can be substituted with adenine, cytosine, thymine, or any of the nucleotides described herein. In another non-limiting example, the substitution of guanine bases in the polynucleotide can be designed so as to leave one guanine base in the region downstream of the transcription start site and before the start codon (see Esvelt et al. Nature (2011) 472(7344):499-503; the contents of which is herein incorporated by reference in its entirety). As a non-limiting example, at least 5 nucleotides can be inserted at 1 location downstream of the transcription start site but upstream of the start codon and the at least 5 nucleotides can be the same base type.

Polynucleotide Comprising an mRNA Encoding a Relaxin Polypeptide

In certain embodiments, a polynucleotide of the present disclosure, for example a polynucleotide comprising an mRNA nucleotide sequence encoding a relaxin polypeptide, comprises from 5' to 3' end:

(i) a 5' cap provided above;

(ii) a 5' UTR, such as the sequences provided above;

(iii) an open reading frame encoding a relaxin polypeptide, e.g., a sequence optimized nucleic acid sequence encoding a relaxin polypeptide disclosed herein;

(iv) at least one stop codon;

(v) a 3' UTR, such as the sequences provided above; and (vi) a poly-A tail provided above.

In some embodiments, the polynucleotide further comprises a miRNA binding site, e.g, a miRNA binding site that binds to miRNA-142. In some embodiments, the 5'UTR comprises the miRNA binding site.

In some embodiments, a polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild type relaxin protein.

Methods of Making Polynucleotides

The present disclosure also provides methods for making a polynucleotide of the invention (e.g., a polynucleotide comprising a nucleotide sequence encoding a relaxin polypeptide) or a complement thereof.

In some aspects, a polynucleotide (e.g., a RNA, e.g., an mRNA) disclosed herein, and encoding a relaxin polypeptide, can be constructed using in vitro transcription. In other aspects, a polynucleotide (e.g., a RNA, e.g., an mRNA) disclosed herein, and encoding a relaxin polypeptide, can be constructed by chemical synthesis using an oligonucleotide synthesizer.

In other aspects, a polynucleotide (e.g., a RNA, e.g., an mRNA) disclosed herein, and encoding a relaxin polypeptide is made by using a host cell. In certain aspects, a polynucleotide (e.g., a RNA, e.g., an mRNA) disclosed herein, and encoding a relaxin polypeptide is made by one or more combination of the IVT, chemical synthesis, host cell expression, or any other methods known in the art.

Naturally occurring nucleosides, non-naturally occurring nucleosides, or combinations thereof, can totally or partially naturally replace occurring nucleosides present in the candidate nucleotide sequence and can be incorporated into a sequence-optimized nucleotide sequence (e.g., a RNA, e.g., an mRNA) encoding a relaxin polypeptide. The resultant polynucleotides, e.g., mRNAs, can then be examined for their ability to produce protein and/or produce a relaxin outcome.

a. In Vitro Transcription/Enzymatic Synthesis

The polynucleotides of the present invention disclosed herein (e.g., a polynucleotide comprising a nucleotide sequence encoding a relaxin polypeptide) can be transcribed using an in vitro transcription (IVT) system. The system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate polynucleotides disclosed herein. See U.S. Publ. No.

US20130259923, which is herein incorporated by reference in its entirety.

Any number of RNA polymerases or variants can be used in the synthesis of the polynucleotides of the present invention. RNA polymerases can be modified by inserting or deleting amino acids of the RNA polymerase sequence. As a non-limiting example, the RNA polymerase can be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants can be obtained by evolving an RNA polymerase, optimizing the RNA polymerase amino acid and/or nucleic acid sequence and/or by using other methods known in the art. As a non-limiting example, T7 RNA polymerase variants can be evolved using the continuous directed evolution system set out by Esvelt et al. (Nature 472:499-503 (2011); herein incorporated by reference in its entirety) where clones of T7 RNA polymerase can encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants can encode at least mutation as described in U.S. Pub. Nos. 20100120024 and 20070117112; herein incorporated by reference in their entireties. Variants of RNA polymerase can also include, but are not limited to, substitutional variants, conservative amino acid substitution, insertional variants, deletional variants and/or covalent derivatives.

In one aspect, the polynucleotide can be designed to be recognized by the wild type or variant RNA polymerases. In doing so, the polynucleotide can be modified to contain sites or regions of sequence changes from the wild type or parent chimeric polynucleotide.

Polynucleotide or nucleic acid synthesis reactions can be carried out by enzymatic methods utilizing polymerases. Polymerases catalyze the creation of phosphodiester bonds between nucleotides in a polynucleotide or nucleic acid chain. Currently known DNA polymerases can be divided into different families based on amino acid sequence comparison and crystal structure analysis. DNA polymerase I (pol I) or A polymerase family, including the Klenow fragments of *E. coli*, *Bacillus* DNA polymerase I, *Thermus aquaticus* (Taq) DNA polymerases, and the T7 RNA and DNA polymerases, is among the best studied of these families. Another large family is DNA polymerase α (pol α) or B polymerase family, including all eukaryotic replicating DNA polymerases and polymerases from phages T4 and RB69. Although they employ similar catalytic mechanism, these families of polymerases differ in substrate specificity, substrate analog-incorporating efficiency, degree and rate for primer extension, mode of DNA synthesis, exonuclease activity, and sensitivity against inhibitors.

DNA polymerases are also selected based on the optimum reaction conditions they require, such as reaction temperature, pH, and template and primer concentrations. Sometimes a combination of more than one DNA polymerases is employed to achieve the desired DNA fragment size and synthesis efficiency. For example, Cheng et al. increase pH, add glycerol and dimethyl sulfoxide, decrease denaturation times, increase extension times, and utilize a secondary thermostable DNA polymerase that possesses a 3' to 5' exonuclease activity to effectively amplify long targets from cloned inserts and human genomic DNA. (Cheng et al., PNAS 91:5695-5699 (1994), the contents of which are incorporated herein by reference in their entirety). RNA polymerases from bacteriophage T3, T7, and SP6 have been widely used to prepare RNAs for biochemical and biophysical studies. RNA polymerases, capping enzymes, and poly-A polymerases are disclosed in the co-pending International Publication No. WO2014028429, the contents of which are incorporated herein by reference in their entirety.

In one aspect, the RNA polymerase which can be used in the synthesis of the polynucleotides of the present invention is a Syn5 RNA polymerase. (see Zhu et al. Nucleic Acids Research 2013, doi: 10.1093/nar/gkt 1193, which is herein incorporated by reference in its entirety). The Syn5 RNA polymerase was recently characterized from marine cyanophage Syn5 by Zhu et al. where they also identified the promoter sequence (see Zhu et al. Nucleic Acids Research 2013, the contents of which is herein incorporated by reference in its entirety). Zhu et al. found that Syn5 RNA polymerase catalyzed RNA synthesis over a wider range of temperatures and salinity as compared to T7 RNA polymerase. Additionally, the requirement for the initiating nucleotide at the promoter was found to be less stringent for Syn5 RNA polymerase as compared to the T7 RNA polymerase making Syn5 RNA polymerase promising for RNA synthesis.

In one aspect, a Syn5 RNA polymerase can be used in the synthesis of the polynucleotides described herein. As a non-limiting example, a Syn5 RNA polymerase can be used in the synthesis of the polynucleotide requiring a precise 3'-terminus.

In one aspect, a Syn5 promoter can be used in the synthesis of the polynucleotides. As a non-limiting example, the Syn5 promoter can be 5'-ATTGGGCACCCGTAAGGG-3' (SEQ ID NO: 544) as described by Zhu et al. (Nucleic Acids Research 2013).

In one aspect, a Syn5 RNA polymerase can be used in the synthesis of polynucleotides comprising at least one chemical modification described herein and/or known in the art (see e.g., the incorporation of pseudo-UTP and 5Me-CTP described in Zhu et al. Nucleic Acids Research 2013).

In one aspect, the polynucleotides described herein can be synthesized using a Syn5 RNA polymerase which has been purified using modified and improved purification procedure described by Zhu et al. (Nucleic Acids Research 2013).

Various tools in genetic engineering are based on the enzymatic amplification of a target gene which acts as a template. For the study of sequences of individual genes or specific regions of interest and other research needs, it is necessary to generate multiple copies of a target gene from a small sample of polynucleotides or nucleic acids. Such methods can be applied in the manufacture of the polynucleotides of the invention.

For example, polymerase chain reaction (PCR), strand displacement amplification (SDA), nucleic acid sequence-based amplification (NASBA), also called transcription mediated amplification (TMA), and rolling-circle amplification (RCA) can be utilized in the manufacture of one or more regions of the polynucleotides of the present invention.

Assembling polynucleotides or nucleic acids by a ligase is also widely used. DNA or RNA ligases promote intermolecular ligation of the 5' and 3' ends of polynucleotide chains through the formation of a phosphodiester bond.

b. Chemical Synthesis

Standard methods can be applied to synthesize an isolated polynucleotide sequence encoding an isolated polypeptide of interest, such as a polynucleotide of the invention (e.g., a polynucleotide comprising a nucleotide sequence encoding a relaxin polypeptide). For example, a single DNA or RNA oligomer containing a codon-optimized nucleotide sequence coding for the particular isolated polypeptide can be synthesized. In other aspects, several small oligonucleotides coding for portions of the desired polypeptide can be synthesized and then ligated. In some aspects, the individual oligonucleotides typically contain 5' or 3' overhangs for complementary assembly.

A polynucleotide disclosed herein (e.g., a RNA, e.g., an mRNA) can be chemically synthesized using chemical synthesis methods and potential nucleobase substitutions known in the art. See, for example, International Publication Nos. WO2014093924, WO2013052523; WO2013039857, WO2012135805, WO2013151671; U.S. Publ. No. US20130115272; or U.S. Pat. Nos. 8,999,380 or 8,710,200, all of which are herein incorporated by reference in their entireties.

c. Purification of Polynucleotides Encoding Relaxin Polypeptide

Purification of the polynucleotides described herein (e.g., a polynucleotide comprising a nucleotide sequence encoding a relaxin polypeptide) can include, but is not limited to, polynucleotide clean-up, quality assurance and quality control. Clean-up can be performed by methods known in the arts such as, but not limited to, AGENCOURT® beads (Beckman Coulter Genomics, Danvers, Mass.), poly-T beads, LNA™ oligo-T capture probes (EXIQON® Inc., Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC).

The term "purified" when used in relation to a polynucleotide such as a "purified polynucleotide" refers to one that is separated from at least one contaminant. As used herein, a "contaminant" is any substance that makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

In some embodiments, purification of a polynucleotide of the invention (e.g., a polynucleotide comprising a nucleotide sequence encoding a relaxin polypeptide) removes impurities that can reduce or remove an unwanted immune response, e.g., reducing cytokine activity.

In some embodiments, the polynucleotide of the invention (e.g., a polynucleotide comprising a nucleotide sequence encoding a relaxin polypeptide) is purified prior to administration using column chromatography (e.g., strong anion exchange HPLC, weak anion exchange HPLC, reverse phase HPLC (RP-HPLC), and hydrophobic interaction HPLC (HIC-HPLC), or (LCMS)).

In some embodiments, the polynucleotide of the invention (e.g., a polynucleotide comprising a nucleotide sequence a relaxin polypeptide) purified using column chromatography (e.g., strong anion exchange HPLC, weak anion exchange HPLC, reverse phase HPLC (RP-HPLC, hydrophobic interaction HPLC (HIC-HPLC), or (LCMS)) presents increased expression of the encoded relaxin protein compared to the expression level obtained with the same polynucleotide of the present disclosure purified by a different purification method.

In some embodiments, a column chromatography (e.g., strong anion exchange HPLC, weak anion exchange HPLC, reverse phase HPLC (RP-HPLC), hydrophobic interaction HPLC (HIC-HPLC), or (LCMS)) purified polynucleotide comprises a nucleotide sequence encoding a relaxin polypeptide comprising one or more of the point mutations known in the art.

In some embodiments, the use of RP-HPLC purified polynucleotide increases relaxin protein expression levels in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the expression levels of relaxin protein in the cells before the RP-HPLC purified polynucleotide was introduced in the cells, or after a non-RP-HPLC purified polynucleotide was introduced in the cells.

In some embodiments, the use of RP-HPLC purified polynucleotide increases functional relaxin protein expression levels in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the functional expression levels of relaxin protein in the cells before the RP-HPLC purified polynucleotide was introduced in the cells, or after a non-RP-HPLC purified polynucleotide was introduced in the cells.

In some embodiments, the use of RP-HPLC purified polynucleotide increases detectable relaxin activity in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the activity levels of functional relaxin protein in the cells before the RP-HPLC purified polynucleotide was introduced in the cells, or after a non-RP-HPLC purified polynucleotide was introduced in the cells.

In some embodiments, the purified polynucleotide is at least about 80% pure, at least about 85% pure, at least about 90% pure, at least about 95% pure, at least about 96% pure, at least about 97% pure, at least about 98% pure, at least about 99% pure, or about 100% pure.

A quality assurance and/or quality control check can be conducted using methods such as, but not limited to, gel electrophoresis, UV absorbance, or analytical HPLC. In another embodiment, the polynucleotide can be sequenced by methods including, but not limited to reverse-transcriptase-PCR.

d. Quantification of Expressed Polynucleotides Encoding Relaxin Protein

In some embodiments, the polynucleotides of the present invention (e.g., a polynucleotide comprising a nucleotide sequence encoding a relaxin polypeptide), their expression products, as well as degradation products and metabolites can be quantified according to methods known in the art.

In some embodiments, the polynucleotides of the present invention can be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes can be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide can be an expression level, presence, absence, truncation or alteration of the administered construct. It is advantageous to correlate the level with one or more clinical phenotypes or with an assay for a human disease biomarker.

The assay can be performed using construct specific probes, cytometry, qRT-PCR, real-time PCR, PCR, flow cytometry, electrophoresis, mass spectrometry, or combinations thereof while the exosomes can be isolated using immunohistochemical methods such as enzyme linked immunosorbent assay (ELISA) methods. Exosomes can also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present invention differ from the endogenous forms due to the structural or chemical modifications.

In some embodiments, the polynucleotide can be quantified using methods such as, but not limited to, ultraviolet visible spectroscopy (UV/Vis). A non-limiting example of a UV/Vis spectrometer is a NANODROP® spectrometer (ThermoFisher, Waltham, Mass.). The quantified polynucleotide can be analyzed in order to determine if the polynucleotide can be of proper size, check that no degradation of the polynucleotide has occurred. Degradation of the polynucleotide can be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Pharmaceutical Compositions and Formulations

The present invention provides pharmaceutical compositions and formulations that comprise any of the polynucleotides described above. In some embodiments, the composition or formulation further comprises a delivery agent.

In some embodiments, the composition or formulation can contain a polynucleotide comprising a sequence optimized nucleic acid sequence disclosed herein which encodes a relaxin polypeptide. In some embodiments, the composition or formulation can contain a polynucleotide (e.g., a RNA, e.g., an mRNA) comprising a polynucleotide (e.g., an ORF) having significant sequence identity to a sequence optimized nucleic acid sequence disclosed herein which encodes a relaxin polypeptide. In some embodiments, the polynucleotide further comprises a miRNA binding site, e.g., a miRNA binding site that binds miR-142, and/or miR-126.

Pharmaceutical compositions or formulation can optionally comprise one or more additional active substances, e.g., therapeutically and/or prophylactically active substances.

Pharmaceutical compositions or formulation of the present invention can be sterile and/or pyrogen-free. General considerations in the formulation and/or manufacture of pharmaceutical agents can be found, for example, in *Remington: The Science and Practice of Pharmacy* 21$^{st}$ ed., Lippincott Williams & Wilkins, 2005 (incorporated herein by reference in its entirety). In some embodiments, compositions are administered to humans, human patients or subjects. For the purposes of the present disclosure, the phrase "active ingredient" generally refers to polynucleotides to be delivered as described herein.

Formulations and pharmaceutical compositions described herein can be prepared by any method known or hereafter developed in the art of pharmacology. In general, such preparatory methods include the step of associating the active ingredient with an excipient and/or one or more other accessory ingredients, and then, if necessary and/or desirable, dividing, shaping and/or packaging the product into a desired single- or multi-dose unit.

A pharmaceutical composition or formulation in accordance with the present disclosure can be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient that would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure can vary, depending upon the identity, size, and/or condition of the subject being treated and further depending upon the route by which the composition is to be administered.

In some embodiments, the compositions and formulations described herein can contain at least one polynucleotide of the invention. As a non-limiting example, the composition or formulation can contain 1, 2, 3, 4 or 5 polynucleotides of the invention. In some embodiments, the compositions or formulations described herein can comprise more than one type of polynucleotide. In some embodiments, the composition or formulation can comprise a polynucleotide in linear and circular form. In another embodiment, the composition or formulation can comprise a circular polynucleotide and an IVT polynucleotide. In yet another embodiment, the composition or formulation can comprise an IVT polynucleotide, a chimeric polynucleotide and a circular polynucleotide.

Although the descriptions of pharmaceutical compositions and formulations provided herein are principally directed to pharmaceutical compositions and formulations that are suitable for administration to humans, it will be understood by the skilled artisan that such compositions are generally suitable for administration to any other animal, e.g., to non-human animals, e.g. non-human mammals.

The present invention provides pharmaceutical formulations that comprise a polynucleotide described herein (e.g., a polynucleotide comprising a nucleotide sequence encoding a relaxin polypeptide). The polynucleotides described herein can be formulated using one or more excipients to: (1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In some embodiments, the pharmaceutical formulation further comprises a delivery agent, (e.g., a LNP comprising, for instance, a lipid having the Formula (I), (IA), (II), (IIa), (IIb), (IIc), (IId) or (IIe), e.g., any of Compounds 1-232.

A pharmaceutically acceptable excipient, as used herein, includes, but are not limited to, any and all solvents, dispersion media, or other liquid vehicles, dispersion or suspension aids, diluents, granulating and/or dispersing agents, surface active agents, isotonic agents, thickening or emulsifying agents, preservatives, binders, lubricants or oil, coloring, sweetening or flavoring agents, stabilizers, antioxidants, antimicrobial or antifungal agents, osmolality adjusting agents, pH adjusting agents, buffers, chelants, cryoprotectants, and/or bulking agents, as suited to the particular dosage form desired. Various excipients for formulating pharmaceutical compositions and techniques for preparing the composition are known in the art (see Remington: The Science and Practice of Pharmacy, 21st Edition, A. R. Gennaro (Lippincott, Williams & Wilkins, Baltimore, Md., 2006; incorporated herein by reference in its entirety).

Exemplary diluents include, but are not limited to, calcium or sodium carbonate, calcium phosphate, calcium hydrogen phosphate, sodium phosphate, lactose, sucrose, cellulose, microcrystalline cellulose, kaolin, mannitol, sorbitol, etc., and/or combinations thereof.

Exemplary granulating and/or dispersing agents include, but are not limited to, starches, pregelatinized starches, or microcrystalline starch, alginic acid, guar gum, agar, poly (vinyl-pyrrolidone), (providone), cross-linked poly(vinyl-pyrrolidone) (crospovidone), cellulose, methylcellulose, carboxymethyl cellulose, cross-linked sodium carboxymethyl cellulose (croscarmellose), magnesium aluminum silicate (VEEGUM®), sodium lauryl sulfate, etc., and/or combinations thereof.

Exemplary surface active agents and/or emulsifiers include, but are not limited to, natural emulsifiers (e.g., acacia, agar, alginic acid, sodium alginate, tragacanth, chondrux, cholesterol, xanthan, pectin, gelatin, egg yolk, casein, wool fat, cholesterol, wax, and lecithin), sorbitan fatty acid esters (e.g., polyoxyethylene sorbitan monooleate [TWEEN®80], sorbitan monopalmitate [SPAN®40], glyceryl monooleate, polyoxyethylene esters, polyethylene glycol fatty acid esters (e.g., CREMOPHOR®), polyoxyethylene ethers (e.g., polyoxyethylene lauryl ether [BRIJ®30]), PLUORINC®F 68, POLOXAMER®188, etc. and/or combinations thereof.

Exemplary binding agents include, but are not limited to, starch, gelatin, sugars (e.g., sucrose, glucose, dextrose, dextrin, molasses, lactose, lactitol, mannitol), amino acids (e.g., glycine), natural and synthetic gums (e.g., acacia, sodium alginate), ethylcellulose, hydroxyethylcellulose, hydroxypropyl methylcellulose, etc., and combinations thereof.

Oxidation is a potential degradation pathway for mRNA, especially for liquid mRNA formulations. In order to prevent oxidation, antioxidants can be added to the formulations. Exemplary antioxidants include, but are not limited to, alpha tocopherol, ascorbic acid, acorbyl palmitate, benzyl alcohol, butylated hydroxyanisole, m-cresol, methionine, butylated hydroxytoluene, monothioglycerol, sodium or potassium metabisulfite, propionic acid, propyl gallate, sodium ascorbate, etc., and combinations thereof.

Exemplary chelating agents include, but are not limited to, ethylenediaminetetraacetic acid (EDTA), citric acid monohydrate, disodium edetate, fumaric acid, malic acid, phosphoric acid, sodium edetate, tartaric acid, trisodium edetate, etc., and combinations thereof.

Exemplary antimicrobial or antifungal agents include, but are not limited to, benzalkonium chloride, benzethonium chloride, methyl paraben, ethyl paraben, propyl paraben, butyl paraben, benzoic acid, hydroxybenzoic acid, potassium or sodium benzoate, potassium or sodium sorbate, sodium propionate, sorbic acid, etc., and combinations thereof.

Exemplary preservatives include, but are not limited to, vitamin A, vitamin C, vitamin E, beta-carotene, citric acid, ascorbic acid, butylated hydroxyanisol, ethylenediamine, sodium lauryl sulfate (SLS), sodium lauryl ether sulfate (SLES), etc., and combinations thereof.

In some embodiments, the pH of polynucleotide solutions are maintained between pH 5 and pH 8 to improve stability. Exemplary buffers to control pH can include, but are not limited to sodium phosphate, sodium citrate, sodium succinate, histidine (or histidine-HCl), sodium malate, sodium carbonate, etc. and/or combinations thereof.

Exemplary lubricating agents include, but are not limited to, magnesium stearate, calcium stearate, stearic acid, silica, talc, malt, hydrogenated vegetable oils, polyethylene glycol, sodium benzoate, sodium or magnesium lauryl sulfate, etc., and combinations thereof.

The pharmaceutical composition or formulation described here can contain a cryoprotectant to stabilize a polynucleotide described herein during freezing. Exemplary cryoprotectants include, but are not limited to mannitol, sucrose, trehalose, lactose, glycerol, dextrose, etc., and combinations thereof.

The pharmaceutical composition or formulation described here can contain a bulking agent in lyophilized polynucleotide formulations to yield a "pharmaceutically elegant" cake, stabilize the lyophilized polynucleotides during long term (e.g., 36 month) storage. Exemplary bulking agents of the present invention can include, but are not limited to sucrose, trehalose, mannitol, glycine, lactose, raffinose, and combinations thereof.

In some embodiments, the pharmaceutical composition or formulation further comprises a delivery agent. The delivery agent of the present disclosure can include, without limitation, liposomes, lipid nanoparticles, lipidoids, polymers, lipoplexes, microvesicles, exosomes, peptides, proteins, cells transfected with polynucleotides, hyaluronidase, nanoparticle mimics, nanotubes, conjugates, and combinations thereof.

Delivery Agents

The present disclosure provides pharmaceutical compositions with advantageous properties. In particular, the present application provides pharmaceutical compositions comprising a polynucleotide comprising a nucleotide sequence encoding a relaxin polypeptided and a lipid compound described herein.

Accelerated Blood Clearance (ABC)

The invention provides compounds, compositions and methods of use thereof for reducing the effect of ABC on a repeatedly administered active agent such as a biologically active agent. As will be readily apparent, reducing or eliminating altogether the effect of ABC on an administered active agent effectively increases its half-life and thus its efficacy.

In some embodiments the term reducing ABC refers to any reduction in ABC in comparison to a positive reference control ABC inducing LNP such as an MC3 LNP. ABC inducing LNPs cause a reduction in circulating levels of an active agent upon a second or subsequent administration within a given time frame. Thus a reduction in ABC refers to less clearance of circulating agent upon a second or subsequent dose of agent, relative to a standard LNP. The reduction may be, for instance, at least 10%, 15%, 20%, 25%, 30%, 35%, 40%, 45%, 50%, 55%, 60%, 65%, 70%, 75%, 80%, 85%, 90%, 95%, 98%, or 100%. In some embodiments the reduction is 10-100%, 10-50%, 20-100%, 20-50%, 30-100%, 30-50%, 40-100%, 40-80%, 50-90%, or 50-100%. Alternatively the reduction in ABC may be characterized as at least a detectable level of circulating agent following a second or subsequent administration or at least a 2 fold, 3 fold, 4 fold, 5 fold increase in circulating agent relative to circulating agent following administration of a standard LNP. In some embodiments the reduction is a 2-100 fold, 2-50 fold, 3-100 fold, 3-50 fold, 3-20 fold, 4-100 fold, 4-50 fold, 4-40 fold, 4-30 fold, 4-25 fold, 4-20 fold, 4-15 fold, 4-10 fold, 4-5 fold, 5-100 fold, 5-50 fold, 5-40 fold, 5-30 fold, 5-25 fold, 5-20 fold, 5-15 fold, 5-10 fold, 6-100 fold, 6-50 fold, 6-40 fold, 6-30 fold, 6-25 fold, 6-20 fold, 6-15 fold, 6-10 fold, 8-100 fold, 8-50 fold, 8-40 fold, 8-30 fold, 8-25 fold, 8-20 fold, 8-15 fold, 8-10 fold, 10-100 fold, 10-50 fold, 10-40 fold, 10-30 fold, 10-25 fold, 10-20 fold, 10-15 fold, 20-100 fold, 20-50 fold, 20-40 fold, 20-30 fold, or 20-25 fold.

The disclosure provides lipid-comprising compounds and compositions that are less susceptible to clearance and thus have a longer half-life in vivo. This is particularly the case where the compositions are intended for repeated including chronic administration, and even more particularly where such repeated administration occurs within days or weeks.

Significantly, these compositions are less susceptible or altogether circumvent the observed phenomenon of accelerated blood clearance (ABC). ABC is a phenomenon in which certain exogenously administered agents are rapidly cleared from the blood upon second and subsequent administrations. This phenomenon has been observed, in part, for a variety of lipid-containing compositions including but not limited to lipidated agents, liposomes or other lipid-based delivery vehicles, and lipid-encapsulated agents. Heretofore, the basis of ABC has been poorly understood and in some cases attributed to a humoral immune response and accordingly strategies for limiting its impact in vivo particularly in a clinical setting have remained elusive.

This disclosure provides compounds and compositions that are less susceptible, if at all susceptible, to ABC. In some important aspects, such compounds and compositions are lipid-comprising compounds or compositions. The lipid-containing compounds or compositions of this disclosure, surprisingly, do not experience ABC upon second and subsequent administration in vivo. This resistance to ABC renders these compounds and compositions particularly suitable for repeated use in vivo, including for repeated use within short periods of time, including days or 1-2 weeks. This enhanced stability and/or half-life is due, in part, to the inability of these compositions to activate B1a and/or B1b cells and/or conventional B cells, pDCs and/or platelets.

This disclosure therefore provides an elucidation of the mechanism underlying accelerated blood clearance (ABC). It has been found, in accordance with this disclosure and the inventions provided herein, that the ABC phenomenon at least as it relates to lipids and lipid nanoparticles is mediated, at least in part an innate immune response involving B1a and/or B1b cells, pDC and/or platelets. B1a cells are normally responsible for secreting natural antibody, in the form of circulating IgM. This IgM is poly-reactive, meaning that it is able to bind to a variety of antigens, albeit with a relatively low affinity for each.

It has been found in accordance with the invention that some lipidated agents or lipid-comprising formulations such as lipid nanoparticles administered in vivo trigger and are subject to ABC. It has now been found in accordance with the invention that upon administration of a first dose of the LNP, one or more cells involved in generating an innate immune response (referred to herein as sensors) bind such agent, are activated, and then initiate a cascade of immune factors (referred to herein as effectors) that promote ABC and toxicity. For instance, B1a and B1b cells may bind to LNP, become activated (alone or in the presence of other sensors such as pDC and/or effectors such as IL6) and secrete natural IgM that binds to the LNP. Pre-existing natural IgM in the subject may also recognize and bind to the LNP, thereby triggering complement fixation. After administration of the first dose, the production of natural IgM begins within 1-2 hours of administration of the LNP. Typically by about 2-3 weeks the natural IgM is cleared from the system due to the natural half-life of IgM. Natural IgG is produced beginning around 96 hours after administration of the LNP. The agent, when administered in a naïve setting, can exert its biological effects relatively unencumbered by the natural IgM produced post-activation of the B1a cells or B1b cells or natural IgG. The natural IgM and natural IgG are non-specific and thus are distinct from anti-PEG IgM and anti-PEG IgG.

Although Applicant is not bound by mechanism, it is proposed that LNPs trigger ABC and/or toxicity through the following mechanisms. It is believed that when an LNP is administered to a subject the LNP is rapidly transported through the blood to the spleen. The LNPs may encounter immune cells in the blood and/or the spleen. A rapid innate immune response is triggered in response to the presence of the LNP within the blood and/or spleen. Applicant has shown herein that within hours of administration of an LNP several immune sensors have reacted to the presence of the LNP. These sensors include but are not limited to immune cells involved in generating an immune response, such as B cells, pDC, and platelets. The sensors may be present in the spleen, such as in the marginal zone of the spleen and/or in the blood. The LNP may physically interact with one or more sensors, which may interact with other sensors. In such a case the LNP is directly or indirectly interacting with the sensors. The sensors may interact directly with one another in response to recognition of the LNP. For instance many sensors are located in the spleen and can easily interact with one another. Alternatively one or more of the sensors may interact with LNP in the blood and become activated. The activated sensor may then interact directly with other sensors or indirectly (e.g., through the stimulation or production of a messenger such as a cytokine e.g., IL6).

In some embodiments the LNP may interact directly with and activate each of the following sensors: pDC, B1a cells, B1b cells, and platelets. These cells may then interact directly or indirectly with one another to initiate the production of effectors which ultimately lead to the ABC and/or toxicity associated with repeated doses of LNP. For instance, Applicant has shown that LNP administration leads to pDC activation, platelet aggregation and activation and B cell activation. In response to LNP platelets also aggregate and are activated and aggregate with B cells. pDC cells are activated. LNP has been found to interact with the surface of platelets and B cells relatively quickly. Blocking the activation of any one or combination of these sensors in response to LNP is useful for dampening the immune response that would ordinarily occur. This dampening of the immune response results in the avoidance of ABC and/or toxicity.

The sensors once activated produce effectors. An effector, as used herein, is an immune molecule produced by an immune cell, such as a B cell. Effectors include but are not limited to immunoglobulin such as natural IgM and natural IgG and cytokines such as IL6. B1a and B1b cells stimulate the production of natural IgMs within 2-6 hours following administration of an LNP. Natural IgG can be detected within 96 hours. IL6 levels are increased within several hours. The natural IgM and IgG circulate in the body for several days to several weeks. During this time the circulating effectors can interact with newly administered LNPs, triggering those LNPs for clearance by the body. For instance, an effector may recognize and bind to an LNP. The Fc region of the effector may be recognized by and trigger uptake of the decorated LNP by macrophage. The macrophage are then transported to the spleen. The production of effectors by immune sensors is a transient response that correlates with the timing observed for ABC.

If the administered dose is the second or subsequent administered dose, and if such second or subsequent dose is administered before the previously induced natural IgM and/or IgG is cleared from the system (e.g., before the 2-3 window time period), then such second or subsequent dose is targeted by the circulating natural IgM and/or natural IgG or Fc which trigger alternative complement pathway activation and is itself rapidly cleared. When LNP are administered after the effectors have cleared from the body or are reduced in number, ABC is not observed.

Thus, it is useful according to aspects of the invention to inhibit the interaction between LNP and one or more sensors, to inhibit the activation of one or more sensors by LNP (direct or indirect), to inhibit the production of one or more effectors, and/or to inhibit the activity of one or more effectors. In some embodiments the LNP is designed to limit or block interaction of the LNP with a sensor. For instance the LNP may have an altered PC and/or PEG to prevent interactions with sensors. Alternatively or additionally an agent that inhibits immune responses induced by LNPs may be used to achieve any one or more of these effects.

It has also been determined that conventional B cells are also implicated in ABC. Specifically, upon first administration of an agent, conventional B cells, referred to herein as CD19(+), bind to and react against the agent. Unlike B1a and B1b cells though, conventional B cells are able to mount first an IgM response (beginning around 96 hours after administration of the LNPs) followed by an IgG response (beginning around 14 days after administration of the LNPs) concomitant with a memory response. Thus conventional B cells react against the administered agent and contribute to IgM (and eventually IgG) that mediates ABC. The IgM and IgG are typically anti-PEG IgM and anti-PEG IgG.

It is contemplated that in some instances, the majority of the ABC response is mediated through B1a cells and B1a-mediated immune responses. It is further contemplated that in some instances, the ABC response is mediated by both IgM and IgG, with both conventional B cells and B1a cells mediating such effects. In yet still other instances, the ABC response is mediated by natural IgM molecules, some of which are capable of binding to natural IgM, which may be produced by activated B1a cells. The natural IgMs may bind to one or more components of the LNPs, e.g., binding to a phospholipid component of the LNPs (such as binding to the PC moiety of the phospholipid) and/or binding to a PEG-lipid component of the LNPs (such as binding to PEG-DMG, in particular, binding to the PEG moiety of PEG-DMG). Since B1a expresses CD36, to which phosphatidylcholine is a ligand, it is contemplated that the CD36 receptor may mediate the activation of B1a cells and thus production of natural IgM. In yet still other instances, the ABC response is mediated primarily by conventional B cells.

It has been found in accordance with the invention that the ABC phenomenon can be reduced or abrogated, at least in part, through the use of compounds and compositions (such as agents, delivery vehicles, and formulations) that do not activate B1a cells. Compounds and compositions that do not activate B1a cells may be referred to herein as B1a inert compounds and compositions. It has been further found in accordance with the invention that the ABC phenomenon can be reduced or abrogated, at least in part, through the use of compounds and compositions that do not activate conventional B cells. Compounds and compositions that do not activate conventional B cells may in some embodiments be referred to herein as CD19-inert compounds and compositions. Thus, in some embodiments provided herein, the compounds and compositions do not activate B1a cells and they do not activate conventional B cells. Compounds and compositions that do not activate B1a cells and conventional B cells may in some embodiments be referred to herein as B1a/CD19-inert compounds and compositions.

These underlying mechanisms were not heretofore understood, and the role of B1a and B1b cells and their interplay with conventional B cells in this phenomenon was also not appreciated.

Accordingly, this disclosure provides compounds and compositions that do not promote ABC. These may be further characterized as not capable of activating B1a and/or B1b cells, platelets and/or pDC, and optionally conventional B cells also. These compounds (e.g., agents, including biologically active agents such as prophylactic agents, therapeutic agents and diagnostic agents, delivery vehicles, including liposomes, lipid nanoparticles, and other lipid-based encapsulating structures, etc.) and compositions (e.g., formulations, etc.) are particularly desirable for applications requiring repeated administration, and in particular repeated administrations that occur within with short periods of time (e.g., within 1-2 weeks). This is the case, for example, if the agent is a nucleic acid based therapeutic that is provided to a subject at regular, closely-spaced intervals. The findings provided herein may be applied to these and other agents that are similarly administered and/or that are subject to ABC.

Of particular interest are lipid-comprising compounds, lipid-comprising particles, and lipid-comprising compositions as these are known to be susceptible to ABC. Such lipid-comprising compounds particles, and compositions have been used extensively as biologically active agents or as delivery vehicles for such agents. Thus, the ability to improve their efficacy of such agents, whether by reducing the effect of ABC on the agent itself or on its delivery vehicle, is beneficial for a wide variety of active agents.

Also provided herein are compositions that do not stimulate or boost an acute phase response (ARP) associated with repeat dose administration of one or more biologically active agents.

The composition, in some instances, may not bind to IgM, including but not limited to natural IgM.

The composition, in some instances, may not bind to an acute phase protein such as but not limited to C-reactive protein.

The composition, in some instances, may not trigger a CD5(+) mediated immune response. As used herein, a CD5(+) mediated immune response is an immune response that is mediated by B1a and/or B1b cells. Such a response may include an ABC response, an acute phase response, induction of natural IgM and/or IgG, and the like.

The composition, in some instances, may not trigger a CD19(+) mediated immune response. As used herein, a CD19(+) mediated immune response is an immune response that is mediated by conventional CD19(+), CD5(−) B cells. Such a response may include induction of IgM, induction of IgG, induction of memory B cells, an ABC response, an anti-drug antibody (ADA) response including an anti-protein response where the protein may be encapsulated within an LNP, and the like.

B1a cells are a subset of B cells involved in innate immunity. These cells are the source of circulating IgM, referred to as natural antibody or natural serum antibody. Natural IgM antibodies are characterized as having weak affinity for a number of antigens, and therefore they are referred to as "poly-specific" or "poly-reactive", indicating their ability to bind to more than one antigen. B1a cells are not able to produce IgG. Additionally, they do not develop into memory cells and thus do not contribute to an adaptive immune response. However, they are able to secrete IgM upon activation. The secreted IgM is typically cleared within about 2-3 weeks, at which point the immune system is rendered relatively naïve to the previously administered antigen. If the same antigen is presented after this time period (e.g., at about 3 weeks after the initial exposure), the antigen is not rapidly cleared. However, significantly, if the antigen is presented within that time period (e.g., within 2 weeks, including within 1 week, or within days), then the antigen is rapidly cleared. This delay between consecutive doses has rendered certain lipid-containing therapeutic or diagnostic agents unsuitable for use.

In humans, B1a cells are CD19(+), CD20(+), CD27(+), CD43(+), CD70(−) and CD5(+). In mice, B1a cells are CD19(+), CD5(+), and CD45 B cell isoform B220(+). It is the expression of CD5 which typically distinguishes B1a cells from other convention B cells. B1a cells may express high levels of CD5, and on this basis may be distinguished from other B-1 cells such as B-1b cells which express low or undetectable levels of CD5. CD5 is a pan-T cell surface glycoprotein. B1a cells also express CD36, also known as fatty acid translocase. CD36 is a member of the class B scavenger receptor family. CD36 can bind many ligands, including oxidized low density lipoproteins, native lipoproteins, oxidized phospholipids, and long-chain fatty acids.

B1b cells are another subset of B cells involved in innate immunity. These cells are another source of circulating natural IgM. Several antigens, including PS, are capable of inducing T cell independent immunity through B1b activation. CD27 is typically upregulated on B1b cells in response to antigen activation. Similar to B1a cells, the B1b cells are typically located in specific body locations such as the spleen and peritoneal cavity and are in very low abundance in the blood. The B1b secreted natural IgM is typically cleared within about 2-3 weeks, at which point the immune system is rendered relatively naïve to the previously administered antigen. If the same antigen is presented after this time period (e.g., at about 3 weeks after the initial exposure), the antigen is not rapidly cleared. However, significantly, if the antigen is presented within that time period (e.g., within 2 weeks, including within 1 week, or within days), then the antigen is rapidly cleared. This delay between consecutive doses has rendered certain lipid-containing therapeutic or diagnostic agents unsuitable for use.

In some embodiments it is desirable to block B1a and/or B1b cell activation. One strategy for blocking B1a and/or B1b cell activation involves determining which components of a lipid nanoparticle promote B cell activation and neutralizing those components. It has been discovered herein that at least PEG and phosphatidylcholine (PC) contribute to B1a and B1b cell interaction with other cells and/or activation. PEG may play a role in promoting aggregation between B1 cells and platelets, which may lead to activation. PC (a helper lipid in LNPs) is also involved in activating the B1 cells, likely through interaction with the CD36 receptor on the B cell surface. Numerous particles have PEG-lipid alternatives, PEG-less, and/or PC replacement lipids (e.g. oleic acid or analogs thereof) have been designed and tested. Applicant has established that replacement of one or more of these components within an LNP that otherwise would promote ABC upon repeat administration, is useful in preventing ABC by reducing the production of natural IgM and/or B cell activation. Thus, the invention encompasses LNPs that have reduced ABC as a result of a design which eliminates the inclusion of B cell triggers.

Another strategy for blocking B1a and/or B1b cell activation involves using an agent that inhibits immune responses induced by LNPs. These types of agents are discussed in more detail below. In some embodiments these agents block the interaction between B1a/B1b cells and the LNP or platelets or pDC. For instance the agent may be an antibody or other binding agent that physically blocks the interaction. An example of this is an antibody that binds to CD36 or CD6. The agent may also be a compound that prevents or disables the B1a/B1b cell from signaling once activated or prior to activation. For instance, it is possible to block one or more components in the B1a/B1b signaling cascade the results from B cell interaction with LNP or other immune cells. In other embodiments the agent may act one or more effectors produced by the B1a/B1b cells following activation. These effectors include for instance, natural IgM and cytokines.

It has been demonstrated according to aspects of the invention that when activation of pDC cells is blocked, B cell activation in response to LNP is decreased. Thus, in order to avoid ABC and/or toxicity, it may be desirable to prevent pDC activation. Similar to the strategies discussed above, pDC cell activation may be blocked by agents that interfere with the interaction between pDC and LNP and/or B cells/platelets. Alternatively agents that act on the pDC to block its ability to get activated or on its effectors can be used together with the LNP to avoid ABC.

Platelets may also play an important role in ABC and toxicity. Very quickly after a first dose of LNP is administered to a subject platelets associate with the LNP, aggregate and are activated. In some embodiments it is desirable to block platelet aggregation and/or activation. One strategy for blocking platelet aggregation and/or activation involves determining which components of a lipid nanoparticle promote platelet aggregation and/or activation and neutralizing those components. It has been discovered herein that at least PEG contribute to platelet aggregation, activation and/or interaction with other cells. Numerous particles have PEG-lipid alternatives and PEG-less have been designed and tested. Applicant has established that replacement of one or more of these components within an LNP that otherwise would promote ABC upon repeat administration, is useful in preventing ABC by reducing the production of natural IgM and/or platelet aggregation. Thus, the invention encompasses LNPs that have reduced ABC as a result of a design which eliminates the inclusion of platelet triggers. Alternatively agents that act on the platelets to block its activity once it is activated or on its effectors can be used together with the LNP to avoid ABC.

Measuring ABC Activity and Related Activities

Various compounds and compositions provided herein, including LNPs, do not promote ABC activity upon administration in vivo. These LNPs may be characterized and/or identified through any of a number of assays, such as but not limited to those described below, as well as any of the assays disclosed in the Examples section, include the methods subsection of the Examples.

In some embodiments the methods involve administering an LNP without producing an immune response that promotes ABC. An immune response that promotes ABC involves activation of one or more sensors, such as B1 cells, pDC, or platelets, and one or more effectors, such as natural IgM, natural IgG or cytokines such as IL6. Thus administration of an LNP without producing an immune response that promotes ABC, at a minimum involves administration of an LNP without significant activation of one or more sensors and significant production of one or more effectors. Significant used in this context refers to an amount that would lead to the physiological consequence of accelerated blood clearance of all or part of a second dose with respect to the level of blood clearance expected for a second dose of an ABC triggering LNP. For instance, the immune response should be dampened such that the ABC observed after the second dose is lower than would have been expected for an ABC triggering LNP.

B1a or B1b Activation Assay

Certain compositions provided in this disclosure do not activate B cells, such as B1a or B1b cells (CD19+CD5+) and/or conventional B cells (CD19+CD5-). Activation of B1a cells, B1b cells, or conventional B cells may be determined in a number of ways, some of which are provided below. B cell population may be provided as fractionated B cell populations or unfractionated populations of splenocytes or peripheral blood mononuclear cells (PBMC). If the latter, the cell population may be incubated with the LNP of choice for a period of time, and then harvested for further analysis. Alternatively, the supernatant may be harvested and analyzed.

Upregulation of Activation Marker Cell Surface Expression

Activation of B1a cells, B1b cells, or conventional B cells may be demonstrated as increased expression of B cell activation markers including late activation markers such as CD86. In an exemplary non-limiting assay, unfractionated B cells are provided as a splenocyte population or as a PBMC population, incubated with an LNP of choice for a particular period of time, and then stained for a standard B cell marker such as CD19 and for an activation marker such as CD86, and analyzed using for example flow cytometry. A suitable negative control involves incubating the same population with medium, and then performing the same staining and visualization steps. An increase in CD86 expression in the test population compared to the negative control indicates B cell activation.

Pro-Inflammatory Cytokine Release

B cell activation may also be assessed by cytokine release assay. For example, activation may be assessed through the production and/or secretion of cytokines such as IL-6 and/or TNF-alpha upon exposure with LNPs of interest.

Such assays may be performed using routine cytokine secretion assays well known in the art. An increase in cytokine secretion is indicative of B cell activation.

LNP Binding/Association to and/or Uptake by B Cells

LNP association or binding to B cells may also be used to assess an LNP of interest and to further characterize such LNP. Association/binding and/or uptake/internalization may be assessed using a detectably labeled, such as fluorescently labeled, LNP and tracking the location of such LNP in or on B cells following various periods of incubation.

The invention further contemplates that the compositions provided herein may be capable of evading recognition or detection and optionally binding by downstream mediators of ABC such as circulating IgM and/or acute phase response mediators such as acute phase proteins (e.g., C-reactive protein (CRP).

Methods of Use for Reducing ABC

Also provided herein are methods for delivering LNPs, which may encapsulate an agent such as a therapeutic agent, to a subject without promoting ABC.

In some embodiments, the method comprises administering any of the LNPs described herein, which do not promote ABC, for example, do not induce production of natural IgM binding to the LNPs, do not activate B1a and/or B1b cells. As used herein, an LNP that "does not promote ABC" refers to an LNP that induces no immune responses that would lead to substantial ABC or a substantially low level of immune responses that is not sufficient to lead to substantial ABC. An LNP that does not induce the production of natural IgMs binding to the LNP refers to LNPs that induce either no natural IgM binding to the LNPs or a substantially low level of the natural IgM molecules, which is insufficient to lead to substantial ABC. An LNP that does not activate B1a and/or B1b cells refer to LNPs that induce no response of B1a and/or B1b cells to produce natural IgM binding to the LNPs or a substantially low level of B1a and/or B1b responses, which is insufficient to lead to substantial ABC.

In some embodiments the terms do not activate and do not induce production are a relative reduction to a reference value or condition. In some embodiments the reference value or condition is the amount of activation or induction of production of a molecule such as IgM by a standard LNP such as an MC3 LNP. In some embodiments the relative reduction is a reduction of at least 30%, for example at least 30%, 35%, 40%, 45%, 50%, 55%, 60%, 65%, 70%, 75%, 80%, 85%, 90%, 91%, 92%, 93%, 94%, 95%, 96%, 97%, 98%, 99%, or 100%. In other embodiments the terms do not activate cells such as B cells and do not induce production of a protein such as IgM may refer to an undetectable amount of the active cells or the specific protein.

Platelet Effects and Toxicity

The invention is further premised in part on the elucidation of the mechanism underlying dose-limiting toxicity associated with LNP administration. Such toxicity may involve coagulopathy, disseminated intravascular coagulation (DIC, also referred to as consumptive coagulopathy), whether acute or chronic, and/or vascular thrombosis. In some instances, the dose-limiting toxicity associated with LNPs is acute phase response (APR) or complement activation-related psudoallergy (CARPA).

As used herein, coagulopathy refers to increased coagulation (blood clotting) in vivo. The findings reported in this disclosure are consistent with such increased coagulation and significantly provide insight on the underlying mechanism. Coagulation is a process that involves a number of different factors and cell types, and heretofore the relationship between and interaction of LNPs and platelets has not been understood in this regard. This disclosure provides evidence of such interaction and also provides compounds and compositions that are modified to have reduced platelet effect, including reduced platelet association, reduced platelet aggregation, and/or reduced platelet aggregation. The ability to modulate, including preferably down-modulate, such platelet effects can reduce the incidence and/or severity of coagulopathy post-LNP administration. This in turn will reduce toxicity relating to such LNP, thereby allowing higher doses of LNPs and importantly their cargo to be administered to patients in need thereof.

CARPA is a class of acute immune toxicity manifested in hypersensitivity reactions (HSRs), which may be triggered by nanomedicines and biologicals. Unlike allergic reactions, CARPA typically does not involve IgE but arises as a consequence of activation of the complement system, which is part of the innate immune system that enhances the body's abilities to clear pathogens. One or more of the following pathways, the classical complement pathway (CP), the alternative pathway (AP), and the lectin pathway (LP), may be involved in CARPA. Szebeni, Molecular Immunology, 61:163-173 (2014).

The classical pathway is triggered by activation of the C1-complex, which contains. C1q, C1r, C1s, or C1qr2s2. Activation of the C1-complex occurs when C1q binds to IgM or IgG complexed with antigens, or when C1q binds directly to the surface of the pathogen. Such binding leads to conformational changes in the C1q molecule, which leads to the activation of C1r, which in turn, cleave C1s. The C1r2s2 component now splits C4 and then C2, producing C4a, C4b, C2a, and C2b. C4b and C2b bind to form the classical pathway C3-convertase (C4b2b complex), which promotes cleavage of C3 into C3a and C3b. C3b then binds the C3 convertase to from the C5 convertase (C4b2b3b complex). The alternative pathway is continuously activated as a result of spontaneous C3 hydrolysis. Factor P (properdin) is a positive regulator of the alternative pathway. Oligomerization of properdin stabilizes the C3 convertase, which can then cleave much more C3. The C3 molecules can bind to surfaces and recruit more B, D, and P activity, leading to amplification of the complement activation.

Acute phase response (APR) is a complex systemic innate immune responses for preventing infection and clearing potential pathogens. Numerous proteins are involved in APR and C-reactive protein is a well-characterized one.

It has been found, in accordance with the invention, that certain LNP are able to associate physically with platelets almost immediately after administration in vivo, while other LNP do not associate with platelets at all or only at background levels. Significantly, those LNPs that associate with platelets also apparently stabilize the platelet aggregates that are formed thereafter. Physical contact of the platelets with certain LNPs correlates with the ability of such platelets to remain aggregated or to form aggregates continuously for an extended period of time after administration. Such aggregates comprise activated platelets and also innate immune cells such as macrophages and B cells.

a. Lipid Compound

The present disclosure provides pharmaceutical compositions with advantageous properties. For example, the lipids described herein (e.g. those having any of Formula (I), (IA), (II), (IIa), (IIb), (IIc), (IId), (IIe), (III), (IV), (V), or (VI) may be advantageously used in lipid nanoparticle compositions for the delivery of therapeutic and/or prophylactic agents to mammalian cells or organs. For example, the lipids described herein have little or no immunogenicity. For example, the lipid compounds disclosed herein have a lower immunogenicity as compared to a reference lipid (e.g., MC3, KC2, or DLinDMA). For example, a formulation comprising a lipid disclosed herein and a therapeutic or prophylactic agent has an increased therapeutic index as compared to a corresponding formulation which comprises a reference lipid (e.g., MC3, KC2, or DLinDMA) and the same therapeutic or prophylactic agent. In particular, the present application provides pharmaceutical compositions comprising:

(a) a polynucleotide comprising a nucleotide sequence encoding a relaxin polypeptide; and (b) a delivery agent.

In some embodiments, the delivery agent comprises a lipid compound having the Formula (I)

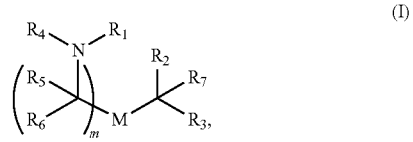

(I)

wherein $R_1$ is selected from the group consisting of $C_{5-30}$ alkyl, $C_{5-20}$ alkenyl, R*YR", YR", and —R"M'R';

$R_2$ and $R_3$ are independently selected from the group consisting of H, $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of a $C_{3-6}$ carbocycle, $(CH_2)_nQ$, $(CH_2)_nCHQR$, —CHQR, $CQ(R)_2$, and unsubstituted $C_{1-6}$ alkyl, where Q is selected from a carbocycle, heterocycle, OR, $O(CH_2)_nN(R)_2$, C(O)OR, OC(O)R, $CX_3$, $CX_2H$, $CXH_2$, CN, $N(R)_2$, —C(O)N(R)_2$, N(R)C(O)R, $N(R)S(O)_2R$, $N(R)C(O)N(R)_2$, $N(R)C(S)N(R)_2$, $N(R)R_8$, —O(CH_2)_nOR, $N(R)C(=NR_9)N(R)_2$, $N(R)C(=CHR_9)N(R)_2$, $OC(O)N(R)_2$, $N(R)C(O)OR$, —N(OR)C(O)R, N(OR)S(O)_2R$, $N(OR)C(O)OR$, $N(OR)C(O)N(R)_2$, $N(OR)C(S)N(R)_2$, —N(OR)C(=NR_9)N(R)_2$, $N(OR)C(=CHR_9)N(R)_2$, $C(=NR_9)N(R)_2$, $C(=NR_9)R$, C(O)N(R)OR, and $C(R)N(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —S(O)R, —S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In some embodiments, a subset of compounds of Formula (I) includes those in which $R_1$ is selected from the group consisting of $C_{5-20}$ alkyl, $C_{5-20}$ alkenyl, R*YR", YR", and —R"M'R';

$R_2$ and $R_3$ are independently selected from the group consisting of H, $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of a $C_{3-6}$ carbocycle, $(CH_2)_nQ$, $(CH_2)_nCHQR$, —CHQR, $CQ(R)_2$, and unsubstituted $C_{1-6}$ alkyl, where Q is selected from a carbocycle, heterocycle, OR, $O(CH_2)_nN(R)_2$, C(O)OR, OC(O)R, $CX_3$, $CX_2H$, $CXH_2$, CN, $N(R)_2$, —C(O)N(R)_2$, N(R)C(O)R, $N(R)S(O)_2R$, $N(R)C(O)N(R)_2$, $N(R)C(S)N(R)_2$, and —C(R)N(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof, wherein alkyl and alkenyl groups may be linear or branched.

In some embodiments, a subset of compounds of Formula (I) includes those in which when $R_4$ is $(CH_2)_nQ$, $(CH_2)_n$CHQR, CHQR, or $CQ(R)_2$, then (i) Q is not $N(R)_2$ when n is 1, 2, 3, 4 or 5, or (ii) Q is not 5, 6, or 7-membered heterocycloalkyl when n is 1 or 2.

In another embodiments, another subset of compounds of Formula (I) includes those in which $R_1$ is selected from the group consisting of $C_{5-30}$ alkyl, $C_{5-20}$ alkenyl, R*YR", YR", and —R"M'R';

$R_2$ and $R_3$ are independently selected from the group consisting of H, $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of a $C_{3-6}$ carbocycle, $(CH_2)_nQ$, $(CH_2)_n$CHQR, —CHQR, $CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, OR, —$O(CH_2)_nN(R)_2$, C(O)OR, OC(O)R, $CX_3$, $CX_2H$, $CXH_2$, CN, $C(O)N(R)_2$, N(R)C(O)R, —$N(R)S(O)_2R$, N(R)C(O)N$(R)_2$, $N(R)C(S)N(R)_2$, —$CRN(R)_2C(O)OR$, —$N(R)R_8$, —$O(CH_2)_nOR$, —$N(R)C(=NR_9)N(R)_2$, —$N(R)C(=CHR_9)N(R)_2$, —OC(O)$N(R)_2$, —N(R)C(O)OR, —N(OR)C(O)R, —$N(OR)S(O)_2R$, —N(OR)C(O)OR, —$N(OR)C(O)N(R)_2$, —$N(OR)C(S)N(R)_2$, —N(OR)C$(=NR_9)N(R)_2$, —$N(OR)C(=CHR_9)N(R)_2$, —$C(=NR_9)N(R)_2$, —$C(=NR_9)R$, —C(O)N(R)OR, and a 5- to 14-membered heterocycloalkyl having one or more heteroatoms selected from N, O, and S which is substituted with one or more substituents selected from oxo (=O), OH, amino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, —S—S—, an aryl group, and a heteroaryl group;

$R_7$ is selected from the group consisting of $C_{1-3}$ alkyl, $C_{2-3}$ alkenyl, and H;

$R_8$ is selected from the group consisting of $C_{3-6}$ carbocycle and heterocycle;

$R_9$ is selected from the group consisting of H, CN, $NO_2$, $C_{1-6}$ alkyl, —OR, —$S(O)_2R$, —$S(O)_2N(R)_2$, $C_{2-6}$ alkenyl, $C_{3-6}$ carbocycle and heterocycle;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In another embodiments, another subset of compounds of Formula (I) includes those in which $R_1$ is selected from the group consisting of $C_{5-30}$ alkyl, $C_{5-20}$ alkenyl, R*YR", YR", and —R"M'R';

$R_2$ and $R_3$ are independently selected from the group consisting of H, $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of a $C_{3-6}$ carbocycle, $(CH_2)_nQ$, $(CH_2)_n$CHQR, —CHQR, $CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, OR, —$O(CH_2)_nN(R)_2$, C(O)OR, OC(O)R, $CX_3$, $CX_2H$, $CXH_2$, CN, $C(O)N(R)_2$, N(R)C(O)R, —$N(R)S(O)_2R$, N(R)C(O)N$(R)_2$, $N(R)C(S)N(R)_2$, $CRN(R)_2C(O)OR$, and a 5- to 14-membered heterocycloalkyl having one or more heteroatoms selected from N, O, and S which is substituted with one or more substituents selected from oxo (=O), OH, amino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which $R_1$ is selected from the group consisting of $C_{5-20}$ alkyl, $C_{5-20}$ alkenyl, R*YR", YR", and —R"M'R';

$R_2$ and $R_3$ are independently selected from the group consisting of H, $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of a $C_{3-6}$ carbocycle, $(CH_2)_nQ$, $(CH_2)$CHQR, —CHQR, $CQ(R)_2$, and unsubstituted $C_{1-6}$ alkyl, where Q is selected from a $C_{3-6}$ carbocycle, a 5- to 14-membered heterocycle having one or more heteroatoms selected from N, O, and S, OR, $O(CH_2)_nN(R)_2$, C(O)OR, OC(O)R, $CX_3$, $CX_2H$, $CXH_2$, CN, $C(O)N(R)_2$, N(R)C(O)R, —$N(R)S(O)_2R$, $N(R)C(O)N(R)_2$, $N(R)C(S)N(R)_2$, $CRN(R)_2C(O)OR$, $N(R)R_8$, $O(CH_2)_nOR$, —N(R)C$(=NR_9)N(R)_2$, $N(R)C(=CHR_9)N(R)_2$, $OC(O)N(R)_2$, N(R)C(O)OR, N(OR)C(O)R, —$N(OR)S(O)_2R$, N(OR)C(O)

OR, N(OR)C(O)N(R)$_2$, N(OR)C(S)N(R)$_2$, N(OR)C(=NR$_9$)N(R)$_2$, N(OR)C(=CHR$_9$)N(R)$_2$, C(=NR$_9$)R, C(O)N(R)OR, and C(=NR$_9$)N(R)$_2$, and each n is independently selected from 1, 2, 3, 4, and 5; and when Q is a 5- to 14-membered heterocycle and (i) R$_4$ is (CH$_2$)$_n$Q in which n is 1 or 2, or (ii) R$_4$ is (CH$_2$)$_n$CHQR in which n is 1, or (iii) R$_4$ is CHQR, and CQ(R)$_2$, then Q is either a 5- to 14-membered heteroaryl or 8- to 14-membered heterocycloalkyl;

each R$_5$ is independently selected from the group consisting of C$_{13}$ alkyl, C$_{23}$ alkenyl, and H;

each R$_6$ is independently selected from the group consisting of C$_{13}$ alkyl, C$_{23}$ alkenyl, and H;

M and M' are independently selected from C(O)O, OC(O), C(O)N(R'), N(R')C(O), —C(O), C(S), C(S)S, SC(S), CH(OH), P(O)(OR')O, S(O)$_2$, —S—S—, an aryl group, and a heteroaryl group;

R$_7$ is selected from the group consisting of C$_{13}$ alkyl, C$_{23}$ alkenyl, and H;

R$_8$ is selected from the group consisting of C$_{3-6}$ carbocycle and heterocycle;

R$_9$ is selected from the group consisting of H, CN, NO$_2$, C$_{1-6}$ alkyl, —OR, —S(O)$_2$R, —S(O)$_2$N(R)$_2$, C$_{2-6}$ alkenyl, C$_{3-6}$ carbocycle and heterocycle;

each R is independently selected from the group consisting of C$_{13}$ alkyl, C$_{23}$ alkenyl, and H;

each R' is independently selected from the group consisting of C$_{118}$ alkyl, C$_{218}$ alkenyl, —R*YR", YR", and H;

each R" is independently selected from the group consisting of C$_{314}$ alkyl and C$_{314}$ alkenyl;

each R* is independently selected from the group consisting of C$_{112}$ alkyl and C$_{212}$ alkenyl;

each Y is independently a C$_{36}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which R$_1$ is selected from the group consisting of C$_{520}$ alkyl, C$_{520}$ alkenyl, R*YR", YR", and —R"M'R';

R$_2$ and R$_3$ are independently selected from the group consisting of H, C$_{114}$ alkyl, C$_{214}$ alkenyl, R*YR", YR", and R*OR", or R$_2$ and R$_3$, together with the atom to which they are attached, form a heterocycle or carbocycle;

R$_4$ is selected from the group consisting of a C$_{36}$ carbocycle, (CH$_2$)$_n$Q, (CH$_2$)$_n$CHQR, —CHQR, CQ(R)$_2$, and unsubstituted C$_{16}$ alkyl, where Q is selected from a C$_{36}$ carbocycle, a 5- to 14-membered heterocycle having one or more heteroatoms selected from N, O, and S, OR, O(CH$_2$)$_n$N(R)$_2$, C(O)OR, OC(O)R, CX$_3$, CX$_2$H, CXH$_2$, CN, C(O)N(R)$_2$, N(R)C(O)R, —N(R)S(O)$_2$R, N(R)C(O)N(R)$_2$, N(R)C(S)N(R)$_2$, CRN(R)$_2$C(O)OR, and each n is independently selected from 1, 2, 3, 4, and 5; and when Q is a 5- to 14-membered heterocycle and (i) R$_4$ is (CH$_2$)$_n$Q in which n is 1 or 2, or (ii) R$_4$ is (CH$_2$)$_n$CHQR in which n is 1, or (iii) R$_4$ is CHQR, and CQ(R)$_2$, then Q is either a 5- to 14-membered heteroaryl or 8- to 14-membered heterocycloalkyl;

each R$_5$ is independently selected from the group consisting of C$_{13}$ alkyl, C$_{23}$ alkenyl, and H;

each R$_6$ is independently selected from the group consisting of C$_{13}$ alkyl, C$_{23}$ alkenyl, and H;

M and M' are independently selected from C(O)O, OC(O), C(O)N(R'), N(R')C(O), —C(O), C(S), C(S)S, SC(S), CH(OH), P(O)(OR')O, S(O)$_2$, an aryl group, and a heteroaryl group;

R$_7$ is selected from the group consisting of C$_{13}$ alkyl, C$_{23}$ alkenyl, and H;

each R is independently selected from the group consisting of C$_{13}$ alkyl, C$_{23}$ alkenyl, and H;

each R' is independently selected from the group consisting of C$_{118}$ alkyl, C$_{218}$ alkenyl, —R*YR", YR", and H;

each R" is independently selected from the group consisting of C$_{314}$ alkyl and C$_{314}$ alkenyl;

each R* is independently selected from the group consisting of C$_{112}$ alkyl and C$_{212}$ alkenyl;

each Y is independently a C$_{36}$ carbocycle;

each X is independently selected from the group consisting of F, Cl, Br, and I; and m is selected from 5, 6, 7, 8, 9, 10, 11, 12, and 13, or salts or stereoisomers thereof.

In still another embodiments, another subset of compounds of Formula (I) includes those in which R$_1$ is selected from the group consisting of C$_{530}$ alkyl, C$_{520}$ alkenyl, R*YR", YR", and —R"M'R';

R$_2$ and R$_3$ are independently selected from the group consisting of H, C$_{114}$ alkyl, C$_{214}$ alkenyl, R*YR", YR", and R*OR", or R$_2$ and R$_3$, together with the atom to which they are attached, form a heterocycle or carbocycle;

R$_4$ is selected from the group consisting of a C$_{36}$ carbocycle, (CH$_2$)$_n$Q, (CH$_2$)$_n$CHQR, —CHQR, CQ(R)$_2$, and unsubstituted C$_{16}$ alkyl, where Q is selected from a C$_{36}$ carbocycle, a 5- to 14-membered heteroaryl having one or more heteroatoms selected from N, O, and S, —OR, O(CH$_2$)$_n$ N(R)$_2$, C(O)OR, OC(O)R, CX$_3$, CX$_2$H, CXH$_2$, CN, C(O)N(R)$_2$, N(R)C(O)R, —N(R)S(O)$_2$R, N(R)C(O)N(R)$_2$, N(R)C(S)N(R)$_2$, CRN(R)$_2$C(O)OR, N(R)R$_8$, —O(CH$_2$)$_n$OR, —N(R)C(=NR$_9$)N(R)$_2$, N(R)C(=CHR$_9$)N(R)$_2$, OC(O)N(R)$_2$, —N(R)C(O)OR, N(OR)C(O)R, —N(OR)S(O)$_2$R, N(OR)C(O)OR, N(OR)C(O)N(R)$_2$, N(OR)C(S)N(R)$_2$, N(OR)C(=NR$_9$)N(R)$_2$, N(OR)C(=CHR$_9$)N(R)$_2$, C(=NR$_9$)R, C(O)N(R)OR, and C(=NR$_9$)N(R)$_2$, and each n is independently selected from 1, 2, 3, 4, and 5;

each R$_5$ is independently selected from the group consisting of C$_{13}$ alkyl, C$_{23}$ alkenyl, and H;

each R$_6$ is independently selected from the group consisting of C$_{13}$ alkyl, C$_{23}$ alkenyl, and H;

M and M' are independently selected from C(O)O, OC(O), C(O)N(R'), N(R')C(O), —C(O), C(S), C(S)S, SC(S), CH(OH), P(O)(OR')O, S(O)$_2$, —S—S—, an aryl group, and a heteroaryl group;

R$_7$ is selected from the group consisting of C$_{13}$ alkyl, C$_{23}$ alkenyl, and H;

R$_8$ is selected from the group consisting of C$_{3-6}$ carbocycle and heterocycle;

R$_9$ is selected from the group consisting of H, CN, NO$_2$, C$_{1-6}$ alkyl, —OR, —S(O)$_2$R, —S(O)$_2$N(R)$_2$, C$_{2-6}$ alkenyl, C$_{3-6}$ carbocycle and heterocycle;

each R is independently selected from the group consisting of C$_{13}$ alkyl, C$_{23}$ alkenyl, and H;

each R' is independently selected from the group consisting of C$_{118}$ alkyl, C$_{218}$ alkenyl, —R*YR", YR", and H;

each R" is independently selected from the group consisting of C$_{3-14}$ alkyl and C$_{314}$ alkenyl;

each R* is independently selected from the group consisting of C$_{112}$ alkyl and C$_{212}$ alkenyl;

each Y is independently a C$_{36}$ carbocycle;

each X is independently selected from the group consisting of F, Cl, Br, and I; and m is selected from 5, 6, 7, 8, 9, 10, 11, 12, and 13, or salts or stereoisomers thereof.

In still another embodiments, another subset of compounds of Formula (I) includes those in which R$_1$ is selected from the group consisting of C$_{520}$ alkyl, C$_{520}$ alkenyl, R*YR", YR", and —R"M'R';

$R_2$ and $R_3$ are independently selected from the group consisting of H, $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of a $C_{3-6}$ carbocycle, $(CH_2)_nQ$, $(CH_2)_nCHQR$, —CHQR, $CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, $O(CH_2)_n N(R)_2$, C(O)OR, OC(O)R, $CX_3$, $CX_2H$, $CXH_2$, CN, $C(O)N(R)_2$, N(R)C(O)R, —$N(R)S(O)_2R$, $N(R)C(O)N(R)_2$, $N(R)C(S)N(R)_2$, $CRN(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which $R_1$ is selected from the group consisting of $C_5$30 alkyl, $C_5$20 alkenyl, R*YR", YR", and —R"M'R';

$R_2$ and $R_3$ are independently selected from the group consisting of H, $C_{2-14}$ alkyl, $C_{2-14}$ alkenyl, R*YR", YR", and R*OR", or $R_2$ and $R_3$, together with the atom to which they are attached, form a heterocycle or carbocycle;

$R_4$ is $(CH_2)_nQ$ or $(CH_2)_nCHQR$, where Q is $N(R)_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which $R_1$ is selected from the group consisting of $C_{5-20}$ alkyl, $C_{5-20}$ alkenyl, R*YR", YR", and —R"M'R';

$R_2$ and $R_3$ are independently selected from the group consisting of H, $C_{2-14}$ alkyl, $C_{2-14}$ alkenyl, R*YR", YR", and R*OR", or $R_2$ and $R_3$, together with the atom to which they are attached, form a heterocycle or carbocycle;

$R_4$ is $(CH_2)_nQ$ or $(CH_2)_nCHQR$, where Q is $N(R)_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In still other embodiments, another subset of compounds of Formula (I) includes those in which $R_1$ is selected from the group consisting of $C_{5-30}$ alkyl, $C_{5-20}$ alkenyl, R*YR", YR", and —R"M'R';

$R_2$ and $R_3$ are independently selected from the group consisting of $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of $(CH_2)_nQ$, $(CH_2)_nCHQR$, CHQR, and $CQ(R)_2$, where Q is $N(R)_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, $S(O)_2$, —S—S—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13,
or salts or stereoisomers thereof.

In still other embodiments, another subset of compounds of Formula (I) includes those in which $R_1$ is selected from the group consisting of $C_{5-20}$ alkyl, $C_{5-20}$ alkenyl, R*YR", YR", and —R"M'R';

$R_2$ and $R_3$ are independently selected from the group consisting of $C_{1-14}$ alkyl, $C_{2-14}$ alkenyl, R*YR", YR", and R*OR", or $R_2$ and $R_3$, together with the atom to which they are attached, form a heterocycle or carbocycle;

$R_4$ is selected from the group consisting of $(CH_2)_nQ$, $(CH_2)_nCHQR$, CHQR, and $CQ(R)_2$, where Q is $N(R)_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from C(O)O, OC(O), C(O)N(R'), N(R')C(O), —C(O), C(S), C(S)S, SC(S), CH(OH), P(O)(OR')O, S(O)$_2$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of C-s18 alkyl, $C_{2-18}$ alkenyl, R*YR", YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13,
or salts or stereoisomers thereof.

In certain embodiments, a subset of compounds of Formula (I) includes those of Formula (IA):

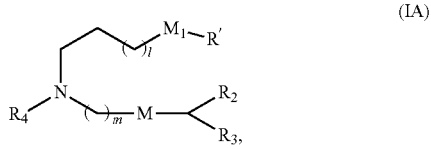

or a salt or stereoisomer thereof, wherein 1 is selected from 1, 2, 3, 4, and 5; m is selected from 5, 6, 7, 8, and 9; $M_1$ is a bond or M'; $R_4$ is unsubstituted $C_{1-3}$ alkyl, or $(CH_2)_nQ$, in which Q is OH, $NHC(S)N(R)_2$, $NHC(O)N(R)_2$, $N(R)C(O)R$, $N(R)S(O)_2R$, $N(R)R_8$, —$NHC(=NR_9)N(R)_2$, $NHC(=CHR_9)N(R)_2$, $OC(O)N(R)_2$, $N(R)C(O)OR$, heteroaryl, or heterocycloalkyl; M and M' are independently selected from C(O)O, OC(O), C(O)N(R'), —P(O)(OR')O, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (IA), or a salt or stereoisomer thereof, wherein l is selected from 1, 2, 3, 4, and 5; m is selected from 5, 6, 7, 8, and 9;

$M_1$ is a bond or M';

$R_4$ is unsubstituted $C_{1-3}$ alkyl, or $(CH_2)_nQ$, in which Q is OH, $NHC(S)N(R)_2$, or —$NHC(O)N(R)_2$;

M and M' are independently selected from C(O)O, OC(O), C(O)N(R'), P(O)(OR')O, an aryl group, and a heteroaryl group; and $R_2$ and $R_3$ are independently selected from the group consisting of H, $C_{1-14}$ alkyl, and $C_{2-14}$ alkenyl.

In certain embodiments, a subset of compounds of Formula (I) includes those of Formula (II):

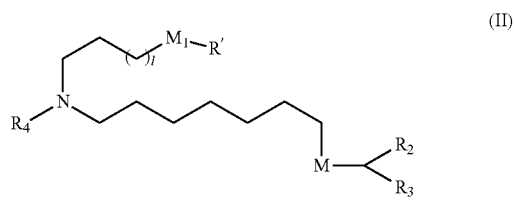

or a salt or stereoisomer thereof, wherein 1 is selected from 1, 2, 3, 4, and 5; $M_1$ is a bond or M'; $R_4$ is unsubstituted $C_{1-3}$ alkyl, or $(CH_2)_nQ$, in which n is 2, 3, or 4, and Q is OH, —$NHC(S)N(R)_2$, $NHC(O)N(R)_2$, $N(R)C(O)R$, $N(R)S(O)_2R$, $N(R)R_8$, $NHC(=NR_9)N(R)_2$, —$NHC(=CHR_9)N(R)_2$, —$OC(O)N(R)_2$, $N(R)C(O)OR$, heteroaryl, or heterocycloalkyl; M and M' are independently selected from C(O)O, OC(O), C(O)N(R'), P(O)(OR')O, —S—S—, an aryl group, and a heteroaryl group; and $R_2$ and $R_3$ are independently selected from the group consisting of H, $C_{1-14}$ alkyl, and $C_{2-14}$ alkenyl.

In some embodiments, a subset of compounds of Formula (I) includes those of Formula (II), or a salt or stereoisomer thereof, wherein l is selected from 1, 2, 3, 4, and 5;

$M_1$ is a bond or M';

$R_4$ is unsubstituted $C_{1-3}$ alkyl, or $(CH_2)_nQ$, in which n is 2, 3, or 4, and Q is OH, —$NHC(S)N(R)_2$, or $NHC(O)N(R)_2$;

M and M' are independently selected from C(O)O, OC(O), C(O)N(R'), P(O)(OR')O, an aryl group, and a heteroaryl group; and $R_2$ and $R_3$ are independently selected from the group consisting of H, $C_{1-14}$ alkyl, and $C_{2-14}$ alkenyl.

In some embodiments, the compound of Formula (I) is of the Formula (IIa),

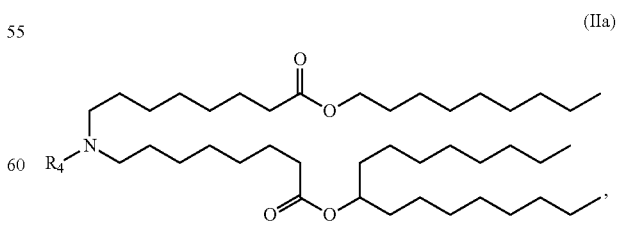

or a salt thereof, wherein $R_4$ is as described above.

In some embodiments, the compound of Formula (I) is of the Formula (IIb), (IIb)

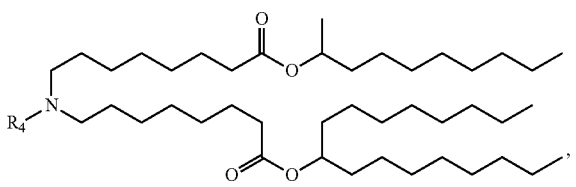

or a salt thereof, wherein $R_4$ is as described above.

In some embodiments, the compound of Formula (I) is of the Formula (IIc), (IIc)

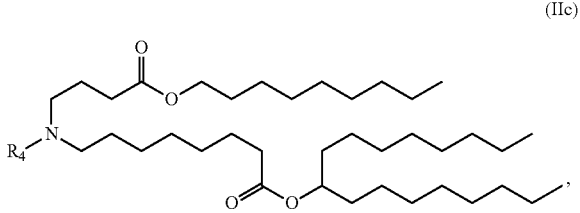

or a salt thereof, wherein $R_4$ is as described above.

In some embodiments, the compound of Formula (I) is of the Formula (IIe):

(IIe)

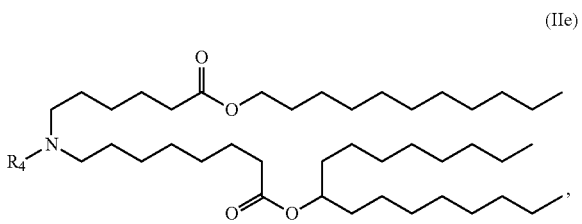

or a salt thereof, wherein $R_4$ is as described above.

In some embodiments, the compound of Formula (IIa), (IIb), (IIc), or (IIe) comprises an $R_4$ which is selected from $(CH_2)_nQ$ and $(CH_2)_nCHQR$, wherein Q, R and n are as defined above.

In some embodiments, Q is selected from the group consisting of OR, OH, —O(CH$_2$)$_n$N(R)$_2$, OC(O)R, CX$_3$, CN, N(R)C(O)R, N(H)C(O)R, N(R)S(O)$_2$R, N(H)S(O)$_2$R, —N(R)C(O)N(R)$_2$, N(H)C(O)N(R)$_2$, N(H)C(O)N(H)(R), N(R)C(S)N(R)$_2$, N(H)C(S)N(R)$_2$, —N(H)C(S)N(H)(R), and a heterocycle, wherein R is as defined above. In some aspects, n is 1 or 2. In some embodiments, Q is OH, NHC(S)N(R)$_2$, or NHC(O)N(R)$_2$.

In some embodiments, the compound of Formula (I) is of the Formula (IId), (IId)

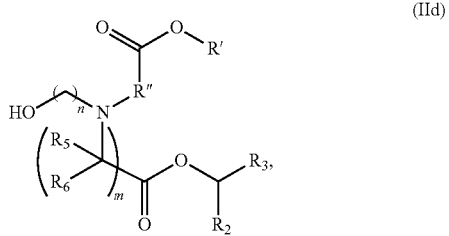

or a salt thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined above.

In some aspects of the compound of Formula (IId), $R_2$ is $C_8$ alkyl. In some aspects of the compound of Formula (IId), $R_3$ is $C_5C_9$ alkyl. In some aspects of the compound of Formula (IId), m is 5, 7, or 9. In some aspects of the compound of Formula (IId), each $R_5$ is H. In some aspects of the compound of Formula (IId), each $R_6$ is H.

In another aspect, the present application provides a lipid composition (e.g., a lipid nanoparticle (LNP)) comprising: (1) a compound having the Formula (I); (2) optionally a helper lipid (e.g. a phospholipid); (3) optionally a structural lipid (e.g. a sterol); and (4) optionally a lipid conjugate (e.g. a PEG-lipid). In exemplary embodiments, the lipid composition (e.g., LNP) further comprises a polynucleotide encoding a relaxin polypeptide, e.g., a polynucleotide encapsulated therein.

As used herein, the term "alkyl" or "alkyl group" means a linear or branched, saturated hydrocarbon including one or more carbon atoms (e.g., one, two, three, four, five, six, seven, eight, nine, ten, eleven, twelve, thirteen, fourteen, fifteen, sixteen, seventeen, eighteen, nineteen, twenty, or more carbon atoms).

The notation "$C_{1-14}$ alkyl" means a linear or branched, saturated hydrocarbon including 1-14 carbon atoms. An alkyl group can be optionally substituted.

As used herein, the term "alkenyl" or "alkenyl group" means a linear or branched hydrocarbon including two or more carbon atoms (e.g., two, three, four, five, six, seven, eight, nine, ten, eleven, twelve, thirteen, fourteen, fifteen, sixteen, seventeen, eighteen, nineteen, twenty, or more carbon atoms) and at least one double bond.

The notation "$C_{2-14}$ alkenyl" means a linear or branched hydrocarbon including 2-14 carbon atoms and at least one double bond. An alkenyl group can include one, two, three, four, or more double bonds. For example, $C_{18}$ alkenyl can include one or more double bonds. A $C_{18}$ alkenyl group including two double bonds can be a linoleyl group. An alkenyl group can be optionally substituted.

As used herein, the term "carbocycle" or "carbocyclic group" means a mono- or multi-cyclic system including one or more rings of carbon atoms. Rings can be three, four, five, six, seven, eight, nine, ten, eleven, twelve, thirteen, fourteen, or fifteen membered rings.

The notation "$C_{3-6}$ carbocycle" means a carbocycle including a single ring having 3-6 carbon atoms. Carbocycles can include one or more double bonds and can be aromatic (e.g., aryl groups). Examples of carbocycles include cyclopropyl, cyclopentyl, cyclohexyl, phenyl, naphthyl, and 1,2-dihydronaphthyl groups. Carbocycles can be optionally substituted.

As used herein, the term "heterocycle" or "heterocyclic group" means a mono- or multi-cyclic system including one or more rings, where at least one ring includes at least one heteroatom. Heteroatoms can be, for example, nitrogen, oxygen, or sulfur atoms. Rings can be three, four, five, six, seven, eight, nine, ten, eleven, or twelve membered rings. Heterocycles can include one or more double bonds and can be aromatic (e.g., heteroaryl groups). Examples of heterocycles include imidazolyl, imidazolidinyl, oxazolyl, oxazolidinyl, thiazolyl, thiazolidinyl, pyrazolidinyl, pyrazolyl, isoxazolidinyl, isoxazolyl, isothiazolidinyl, isothiazolyl, morpholinyl, pyrrolyl, pyrrolidinyl, furyl, tetrahydrofuryl, thiophenyl, pyridinyl, piperidinyl, quinolyl, and isoquinolyl groups. Heterocycles can be optionally substituted.

As used herein, a "biodegradable group" is a group that can facilitate faster metabolism of a lipid in a subject. A biodegradable group can be, but is not limited to, C(O)O, OC(O), —C(O)N(R'), N(R')C(O), C(O), C(S), C(S)S, SC(S), CH(OH), P(O)(OR')O, S(O)$_2$, an aryl group, and a heteroaryl group.

As used herein, an "aryl group" is a carbocyclic group including one or more aromatic rings. Examples of aryl groups include phenyl and naphthyl groups.

As used herein, a "heteroaryl group" is a heterocyclic group including one or more aromatic rings. Examples of heteroaryl groups include pyrrolyl, furyl, thiophenyl, imidazolyl, oxazolyl, and thiazolyl. Both aryl and heteroaryl groups can be optionally substituted. For example, M and M' can be selected from the non-limiting group consisting of optionally substituted phenyl, oxazole, and thiazole. In the formulas herein, M and M' can be independently selected from the list of biodegradable groups above.

Alkyl, alkenyl, and cyclyl (e.g., carbocyclyl and heterocyclyl) groups can be optionally substituted unless otherwise specified. Optional substituents can be selected from the group consisting of, but are not limited to, a halogen atom (e.g., a chloride, bromide, fluoride, or iodide group), a carboxylic acid (e.g., C(O)OH), an alcohol (e.g., a hydroxyl, OH), an ester (e.g., C(O)OR or OC(O)R), an aldehyde (e.g., C(O)H), a carbonyl (e.g., C(O)R, alternatively represented by C=O), an acyl halide (e.g., C(O)X, in which X is a halide selected from bromide, fluoride, chloride, and iodide), a carbonate (e.g., OC(O)OR), an alkoxy (e.g., OR), an acetal (e.g., C(OR)$_2$R'''', in which each OR are alkoxy groups that can be the same or different and R'''' is an alkyl or alkenyl group), a phosphate (e.g., P(O)$_4^3$), a thiol (e.g., SH), a sulfoxide (e.g., S(O)R), a sulfinic acid (e.g., S(O)OH), a sulfonic acid (e.g., S(O)$_2$OH), a thial (e.g., C(S)H), a sulfate (e.g., S(O)$_4^2$), a sulfonyl (e.g., S(O)$_2$), an amide (e.g., C(O)NR$_2$, or —N(R)C(O)R), an azido (e.g., N$_3$), a nitro (e.g., NO$_2$), a cyano (e.g., CN), an isocyano (e.g., —NC), an acyloxy (e.g., OC(O)R), an amino (e.g., NR$_2$, NRH, or NH$_2$), a carbamoyl (e.g., —OC(O)NR$_2$, OC(O)NRH, or OC(O)NH$_2$), a sulfonamide (e.g., S(O)$_2$NR$_2$, S(O)$_2$NRH, —S(O)$_2$NH$_2$, N(R)S(O)$_2$R, N(H)S(O)$_2$R, N(R)S(O)$_2$H, or N(H)S(O)$_2$H), an alkyl group, an alkenyl group, and a cyclyl (e.g., carbocyclyl or heterocyclyl) group.

In any of the preceding, R is an alkyl or alkenyl group, as defined herein. In some embodiments, the substituent groups themselves can be further substituted with, for example, one, two, three, four, five, or six substituents as defined herein. For example, a $C_{16}$ alkyl group can be further substituted with one, two, three, four, five, or six substituents as described herein.

The compounds of any one of formulae (I), (IA), (II), (IIa), (IIb), (IIc), (IId), and (IIe) include one or more of the following features when applicable.

In some embodiments, $R_4$ is selected from the group consisting of a $C_{36}$ carbocycle, —(CH$_2$)$_n$Q, (CH$_2$)$_n$CHQR, CHQR, and CQ(R)$_2$, where Q is selected from a $C_{36}$ carbocycle, 5- to 14-membered aromatic or non-aromatic heterocycle having one or more heteroatoms selected from N, O, S, and P, OR, O(CH$_2$)$_n$N(R)$_2$, C(O)OR, OC(O)R, CX$_3$, CX$_2$H, CXH$_2$, —CN, N(R)$_2$, C(O)N(R)$_2$, N(R)C(O)R, N(R)S(O)$_2$R, N(R)C(O)N(R)$_2$, N(R)C(S)N(R)$_2$, and —C(R)N(R)$_2$C(O)OR, and each n is independently selected from 1, 2, 3, 4, and 5.

In another embodiment, $R_4$ is selected from the group consisting of a $C_{36}$ carbocycle, —(CH$_2$)$_n$Q, (CH$_2$)$_n$CHQR, CHQR, and CQ(R)$_2$, where Q is selected from a $C_{36}$ carbocycle, a 5- to 14-membered heteroaryl having one or more heteroatoms selected from N, O, and S, OR, —O(CH$_2$)$_n$N(R)$_2$, C(O)OR, OC(O)R, CX$_3$, CX$_2$H, CXH$_2$, CN, C(O)N(R)$_2$, N(R)C(O)R, —N(R)S(O)$_2$R, N(R)C(O)N(R)$_2$, N(R)C(S)N(R)$_2$, C(R)N(R)$_2$C(O)OR, and a 5- to 14-membered heterocycloalkyl having one or more heteroatoms selected from N, O, and S which is substituted with one or more substituents selected from oxo (=O), OH, amino, and $C_{13}$ alkyl, and each n is independently selected from 1, 2, 3, 4, and 5.

In another embodiment, $R_4$ is selected from the group consisting of a $C_{36}$ carbocycle, —(CH$_2$)$_n$Q, (CH$_2$)$_n$CHQR, CHQR, and CQ(R)$_2$, where Q is selected from a $C_{36}$ carbocycle, a 5- to 14-membered heterocycle having one or more heteroatoms selected from N, O, and S, OR, O(CH$_2$)$_n$N(R)$_2$, C(O)OR, OC(O)R, CX$_3$, CX$_2$H, CXH$_2$, CN, C(O)N(R)$_2$, N(R)C(O)R, —N(R)S(O)$_2$R, N(R)C(O)N(R)$_2$, N(R)C(S)N(R)$_2$, C(R)N(R)$_2$C(O)OR, and each n is independently selected from 1, 2, 3, 4, and 5; and when Q is a 5- to 14-membered heterocycle and (i) $R_4$ is (CH$_2$)$_n$Q in which n is 1 or 2, or (ii) $R_4$ is (CH$_2$)$_n$CHQR in which n is 1, or (iii) $R_4$ is CHQR, and CQ(R)$_2$, then Q is either a 5- to 14-membered heteroaryl or 8- to 14-membered heterocycloalkyl.

In another embodiment, $R_4$ is selected from the group consisting of a $C_{36}$ carbocycle, —(CH$_2$)$_n$Q, (CH$_2$)$_n$CHQR, CHQR, and CQ(R)$_2$, where Q is selected from a $C_{36}$ carbocycle, a 5- to 14-membered heteroaryl having one or more heteroatoms selected from N, O, and S, OR, —O(CH$_2$)$_n$N(R)$_2$, C(O)OR, OC(O)R, CX$_3$, CX$_2$H, CXH$_2$, CN, C(O)N(R)$_2$, N(R)C(O)R, —N(R)S(O)$_2$R, N(R)C(O)N(R)$_2$, N(R)C(S)N(R)$_2$, C(R)N(R)$_2$C(O)OR, and each n is independently selected from 1, 2, 3, 4, and 5.

In another embodiment, $R_4$ is unsubstituted $C_{14}$ alkyl, e.g., unsubstituted methyl.

In certain embodiments, the disclosure provides a compound having the Formula (I), wherein $R_4$ is (CH$_2$)$_n$Q or (CH$_2$)$_n$CHQR, where Q is N(R)$_2$, and n is selected from 3, 4, and 5.

In certain embodiments, the disclosure provides a compound having the Formula (I), wherein $R_4$ is selected from the group consisting of (CH$_2$)$_n$Q, (CH$_2$)$_n$CHQR, CHQR, and —CQ(R)$_2$, where Q is N(R)$_2$, and n is selected from 1, 2, 3, 4, and 5.

In certain embodiments, the disclosure provides a compound having the Formula (I), wherein $R_2$ and $R_3$ are independently selected from the group consisting of $C_{214}$ alkyl, $C_{214}$ alkenyl, R*YR'', YR'', and R*OR'', or $R_2$ and $R_3$, together with the atom to which they are attached, form a heterocycle or carbocycle, and $R_4$ is (CH$_2$)$_n$Q or (CH$_2$)$_n$CHQR, where Q is —N(R)$_2$, and n is selected from 3, 4, and 5.

In certain embodiments, $R_2$ and $R_3$ are independently selected from the group consisting of $C_{214}$ alkyl, $C_{214}$ alkenyl, R*YR'', YR'', and R*OR'', or $R_2$ and $R_3$, together with the atom to which they are attached, form a heterocycle or carbocycle.

In some embodiments, $R_1$ is selected from the group consisting of $C_{520}$ alkyl and $C_{520}$ alkenyl.

In other embodiments, $R_1$ is selected from the group consisting of R*YR'', YR'', and —R''M'R'.

In certain embodiments, $R_1$ is selected from R*YR'' and YR''. In some embodiments, Y is a cyclopropyl group. In some embodiments, R* is $C_8$ alkyl or $C_8$ alkenyl. In certain embodiments, R'' is $C_{312}$ alkyl. For example, R'' can be $C_3$ alkyl. For example, R'' can be $C_{48}$ alkyl (e.g., $C_4$, $C_5$, $C_6$, $C_7$, or $C_8$ alkyl).

In some embodiments, $R_1$ is $C_{5-20}$ alkyl. In some embodiments, $R_1$ is $C_6$ alkyl. In some embodiments, $R_1$ is $C_8$ alkyl. In other embodiments, $R_1$ is $C_9$ alkyl. In certain embodiments, $R_1$ is $C_{14}$ alkyl. In other embodiments, $R_1$ is $C_{18}$ alkyl.

In some embodiments, $R_1$ is $C_{5-20}$ alkenyl. In certain embodiments, $R_1$ is $C_{18}$ alkenyl. In some embodiments, $R_1$ is linoleyl.

In certain embodiments, $R_1$ is branched (e.g., decan-2-yl, undecan-3-yl, dodecan-4-yl, tridecan-5-yl, tetradecan-6-yl, 2-methylundecan-3-yl, 2-methyldecan-2-yl, 3-methylundecan-3-yl, 4-methyldodecan-4-yl, or heptadeca-9-yl). In certain embodiments, $R_1$ is

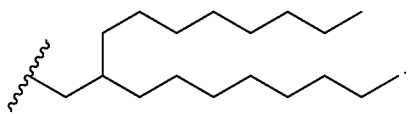 [SMILES: *CC(CCCCCCCC)CCCCCCCC]

In certain embodiments, $R_1$ is unsubstituted $C_{5-20}$ alkyl or $C_{5-20}$ alkenyl. In certain embodiments, R' is substituted $C_{5-20}$ alkyl or $C_{5-20}$ alkenyl (e.g., substituted with a $C_{3-6}$ carbocycle such as 1-cyclopropylnonyl).

In other embodiments, $R_1$ is R"M'R'.

In some embodiments, R' is selected from R*YR" and YR". In some embodiments, Y is $C_{3-8}$ cycloalkyl. In some embodiments, Y is $C_{6-10}$ aryl. In some embodiments, Y is a cyclopropyl group. In some embodiments, Y is a cyclohexyl group. In certain embodiments, R* is $C_1$ alkyl.

In some embodiments, R" is selected from the group consisting of $C_{3-12}$ alkyl and $C_{3-12}$ alkenyl. In some embodiments, R" adjacent to Y is $C_1$ alkyl. In some embodiments, R" adjacent to Y is $C_{4-9}$ alkyl (e.g., $C_4$, $C_5$, $C_6$, $C_7$ or $C_8$ or $C_9$ alkyl).

In some embodiments, R' is selected from $C_4$ alkyl and $C_4$ alkenyl. In certain embodiments, R' is selected from $C_5$ alkyl and $C_5$ alkenyl. In some embodiments, R' is selected from $C_6$ alkyl and $C_6$ alkenyl. In some embodiments, R' is selected from $C_7$ alkyl and $C_7$ alkenyl. In some embodiments, R' is selected from $C_9$ alkyl and $C_9$ alkenyl.

In other embodiments, R' is selected from $C_{11}$ alkyl and $C_{11}$ alkenyl. In other embodiments, R' is selected from $C_{12}$ alkyl, $C_{12}$ alkenyl, $C_{13}$ alkyl, $C_{13}$ alkenyl, $C_{14}$ alkyl, $C_{14}$ alkenyl, $C_{15}$ alkyl, $C_{15}$ alkenyl, $C_{16}$ alkyl, $C_{16}$ alkenyl, $C_{17}$ alkyl, $C_{17}$ alkenyl, $C_{18}$ alkyl, and $C_{18}$ alkenyl. In certain embodiments, R' is branched (e.g., decan-2-yl, undecan-3-yl, dodecan-4-yl, tridecan-5-yl, tetradecan-6-yl, 2-methylundecan-3-yl, 2-methyldecan-2-yl, 3-methylundecan-3-yl, 4-methyldodecan-4-yl or heptadeca-9-yl). In certain embodiments, R' is

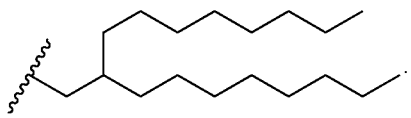 [SMILES: *CC(CCCCCCCC)CCCCCCCC]

In certain embodiments, R' is unsubstituted $C_{1-18}$ alkyl. In certain embodiments, R' is substituted $C_{1-18}$ alkyl (e.g., $C_{1-15}$ alkyl substituted with a $C_{3-6}$ carbocycle such as 1-cyclopropylnonyl).

In some embodiments, R" is selected from the group consisting of $C_{3-14}$ alkyl and $C_{3-14}$ alkenyl. In some embodiments, R" is $C_3$ alkyl, $C_4$ alkyl, $C_5$ alkyl, $C_6$ alkyl, $C_7$ alkyl, or $C_8$ alkyl. In some embodiments, R" is $C_9$ alkyl, $C_{10}$ alkyl, $C_{11}$ alkyl, $C_{12}$ alkyl, $C_{13}$ alkyl, or $C_{14}$ alkyl.

In some embodiments, M' is C(O)O. In some embodiments, M' is OC(O).

In other embodiments, M' is an aryl group or heteroaryl group. For example, M' can be selected from the group consisting of phenyl, oxazole, and thiazole.

In some embodiments, M is C(O)O In some embodiments, M is OC(O). In some embodiments, M is C(O)N(R'). In some embodiments, M is P(O)(OR')O.

In other embodiments, M is an aryl group or heteroaryl group. For example, M can be selected from the group consisting of phenyl, oxazole, and thiazole.

In some embodiments, M is the same as M'. In other embodiments, M is different from M'.

In some embodiments, each $R_5$ is H. In certain such embodiments, each $R_6$ is also H.

In some embodiments, $R_7$ is H. In other embodiments, $R_7$ is $C_{1-3}$ alkyl (e.g., methyl, ethyl, propyl, or i-propyl).

In some embodiments, $R_2$ and $R_3$ are independently $C_{5-14}$ alkyl or $C_{5-14}$ alkenyl.

In some embodiments, $R_2$ and $R_3$ are the same. In some embodiments, $R_2$ and $R_3$ are $C_8$ alkyl. In certain embodiments, $R_2$ and $R_3$ are $C_2$ alkyl. In other embodiments, $R_2$ and $R_3$ are $C_3$ alkyl. In some embodiments, $R_2$ and $R_3$ are $C_4$ alkyl. In certain embodiments, $R_2$ and $R_3$ are $C_5$ alkyl. In other embodiments, $R_2$ and $R_3$ are $C_6$ alkyl. In some embodiments, $R_2$ and $R_3$ are $C_7$ alkyl.

In other embodiments, $R_2$ and $R_3$ are different. In certain embodiments, $R_2$ is $C_8$ alkyl. In some embodiments, $R_3$ is $C_{1-7}$ (e.g., $C_1$, $C_2$, $C_3$, $C_4$, $C_5$, $C_6$, or $C_7$ alkyl) or $C_9$ alkyl.

In some embodiments, $R_7$ and $R_3$ are H.

In certain embodiments, $R_2$ is H.

In some embodiments, m is 5, 7, or 9.

In some embodiments, $R_4$ is selected from $(CH_2)_nQ$ and $(CH_2)_nCHQR$.

In some embodiments, Q is selected from the group consisting of OR, OH, —O(CH$_2$)$_n$N(R)$_2$, OC(O)R, CX$_3$, CN, N(R)C(O)R, N(H)C(O)R, N(R)S(O)$_2$R, N(H)S(O)$_2$R, —N(R)C(O)N(R)$_2$, N(H)C(O)N(R)$_2$, N(H)C(O)N(H)(R), N(R)C(S)N(R)$_2$, N(H)C(S)N(R)$_2$, —N(H)C(S)N(H)(R), C(R)N(R)$_2$C(O)OR, a carbocycle, and a heterocycle.

In certain embodiments, Q is OH.

In certain embodiments, Q is a substituted or unsubstituted 5- to 10-membered heteroaryl, e.g., Q is an imidazole, a pyrimidine, a purine, 2-amino-1,9-dihydro-6H-purin-6-one-9-yl (or guanin-9-yl), adenin-9-yl, cytosin-1-yl, or uracil-1-yl. In certain embodiments, Q is a substituted 5- to 14-membered heterocycloalkyl, e.g., substituted with one or more substituents selected from oxo (=O), OH, amino, and $C_{1-3}$ alkyl. For example, Q is 4-methylpiperazinyl, 4-(4-methoxybenzyl)piperazinyl, or isoindolin-2-yl-1,3-dione.

In certain embodiments, Q is an unsubstituted or substituted $C_{6-10}$ aryl (such as phenyl) or $C_{3-6}$ cycloalkyl.

In some embodiments, n is 1. In other embodiments, n is 2. In further embodiments, n is 3. In certain other embodiments, n is 4. For example, $R_4$ can be (CH$_2$)$_2$OH. For example, $R_4$ can be (CH$_2$)$_3$OH. For example, $R_4$ can be (CH$_2$)$_4$OH. For example, $R_4$ can be benzyl. For example, $R_4$ can be 4-methoxybenzyl.

In some embodiments, $R_4$ is a $C_{3-6}$ carbocycle. In some embodiments, $R_4$ is a $C_{3-6}$ cycloalkyl. For example, $R_4$ can be cyclohexyl optionally substituted with e.g., OH, halo, $C_{1-6}$ alkyl, etc. For example, $R_4$ can be 2-hydroxycyclohexyl.

In some embodiments, R is H.

In some embodiments, R is unsubstituted $C_{1-3}$ alkyl or unsubstituted $C_{2-3}$ alkenyl. For example, $R_4$ can be $CH_2CH(OH)CH_3$ or $CH_2CH(OH)CH_2CH_3$.

In some embodiments, R is substituted $C_{1-3}$ alkyl, e.g., $CH_2OH$. For example, $R_4$ can be —$CH_2CH(OH)CH_2OH$.

In some embodiments, $R_2$ and $R_3$, together with the atom to which they are attached, form a heterocycle or carbocycle. In some embodiments, $R_2$ and $R_3$, together with the atom to which they are attached, form a 5- to 14-membered aromatic or non-aromatic heterocycle having one or more heteroatoms selected from N, O, S, and P. In some embodiments, $R_2$ and $R_3$, together with the atom to which they are attached, form an optionally substituted $C_{3-20}$ carbocycle (e.g., $C_{3-18}$ carbocycle, $C_{3-15}$ carbocycle, $C_{3-12}$ carbocycle, or $C_{3-10}$ carbocycle), either aromatic or non-aromatic. In some embodiments, $R_2$ and $R_3$, together with the atom to which they are attached, form a $C_{3-6}$ carbocycle. In other embodiments, $R_2$ and $R_3$, together with the atom to which they are attached, form a $C_6$ carbocycle, such as a cyclohexyl or phenyl group. In certain embodiments, the heterocycle or $C_{3-6}$ carbocycle is substituted with one or more alkyl groups (e.g., at the same ring atom or at adjacent or non-adjacent ring atoms). For example, $R_2$ and $R_3$, together with the atom to which they are attached, can form a cyclohexyl or phenyl group bearing one or more $C_5$ alkyl substitutions. In certain embodiments, the heterocycle or $C_{3-6}$ carbocycle formed by $R_2$ and $R_3$, is substituted with a carbocycle groups. For example, $R_2$ and $R_3$, together with the atom to which they are attached, can form a cyclohexyl or phenyl group that is substituted with cyclohexyl. In some embodiments, $R_2$ and $R_3$, together with the atom to which they are attached, form a $C_{7-15}$ carbocycle, such as a cycloheptyl, cyclopentadecanyl, or naphthyl group.

In some embodiments, $R_4$ is selected from $(CH_2)_nQ$ and $(CH_2)_nCHQR$. In some embodiments, Q is selected from the group consisting of OR, OH, $O(CH_2)_nN(R)_2$, OC(O)R, —$CX_3$, CN, N(R)C(O)R, N(H)C(O)R, N(R)S(O)_2R$, N(H)S(O)_2R$, N(R)C(O)N(R)_2$, —N(H)C(O)N(R)_2$, N(H)C(O)N(H)(R), N(R)C(S)N(R)_2$, N(H)C(S)N(R)_2$, N(H)C(S)N(H)(R), and a heterocycle. In other embodiments, Q is selected from the group consisting of an imidazole, a pyrimidine, and a purine.

In some embodiments, $R_2$ and $R_3$, together with the atom to which they are attached, form a heterocycle or carbocycle. In some embodiments, $R_2$ and $R_3$, together with the atom to which they are attached, form a $C_{3-6}$ carbocycle, such as a phenyl group. In certain embodiments, the heterocycle or $C_{3-6}$ carbocycle is substituted with one or more alkyl groups (e.g., at the same ring atom or at adjacent or non-adjacent ring atoms). For example, $R_2$ and $R_3$, together with the atom to which they are attached, can form a phenyl group bearing one or more $C_5$ alkyl substitutions.

In some embodiments, the pharmaceutical compositions of the present disclosure, the compound of Formula (I) is selected from the group consisting of:

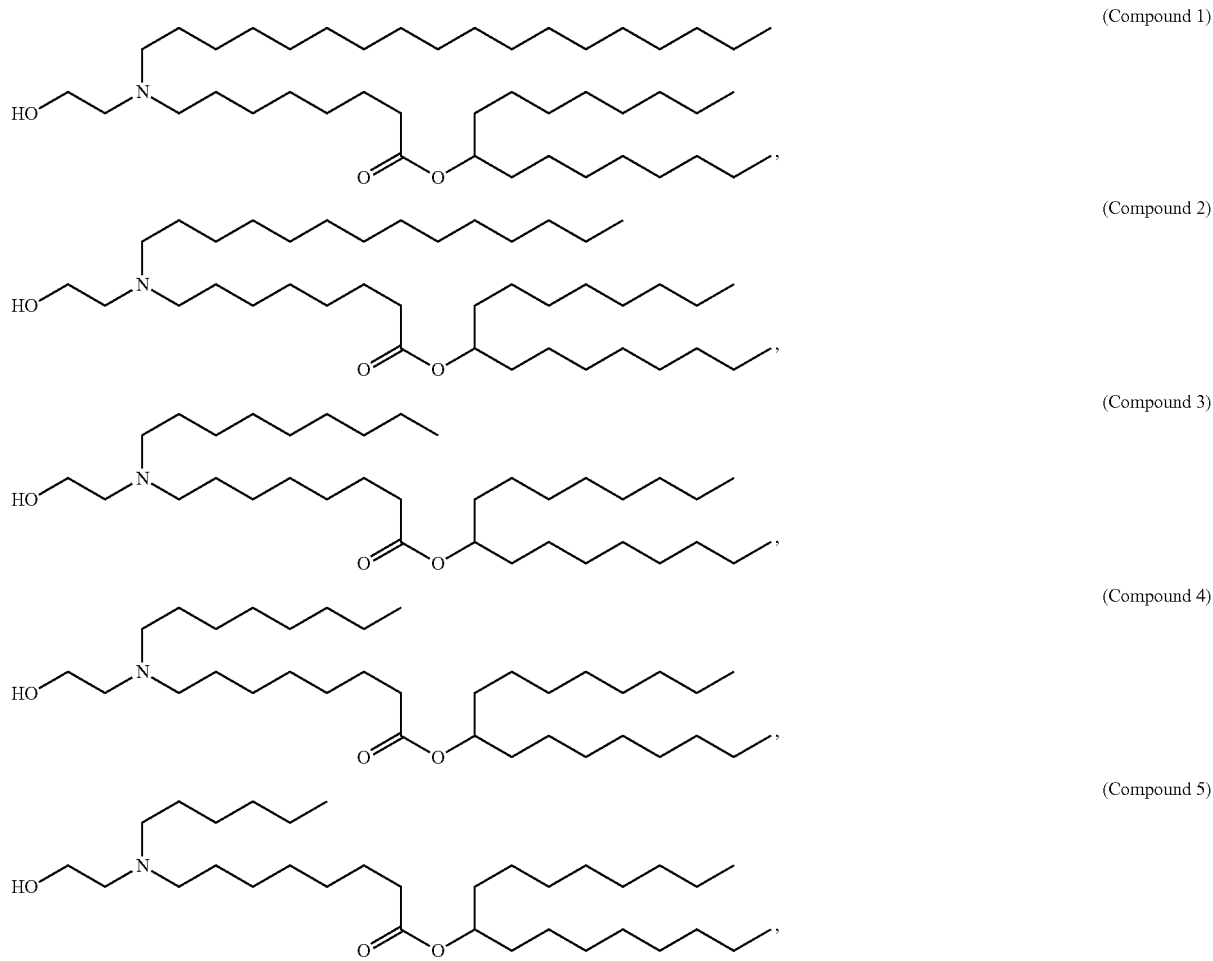

(Compound 1)

(Compound 2)

(Compound 3)

(Compound 4)

(Compound 5)

-continued
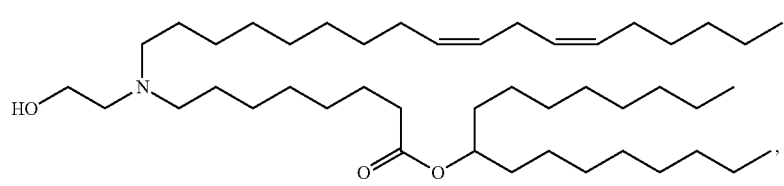
(Compound 6)
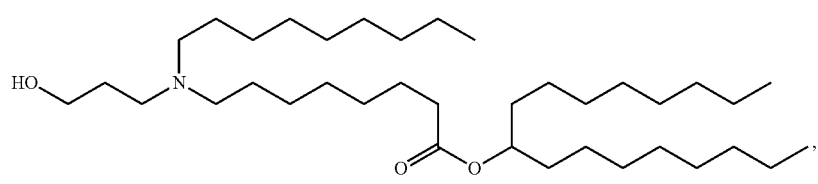
(Compound 7)
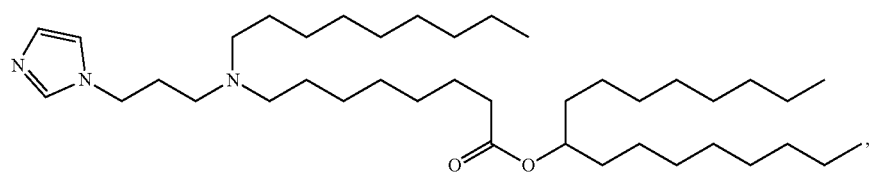
(Compound 8)
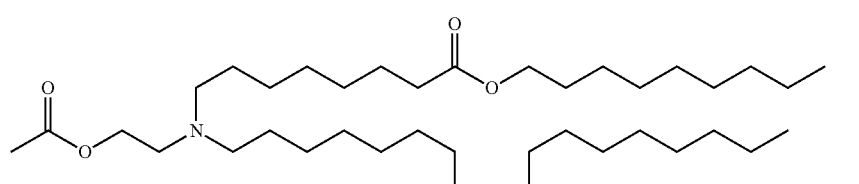
(Compound 9)
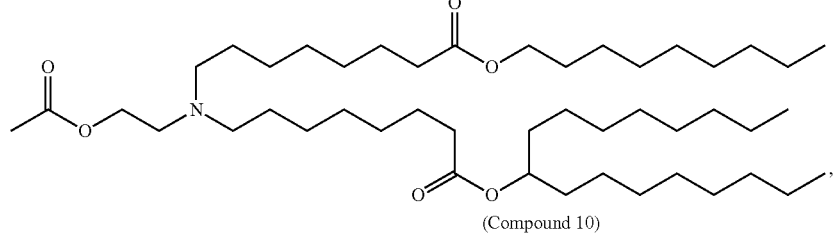
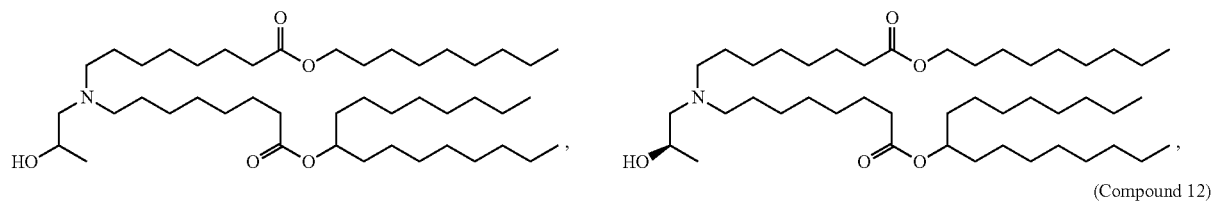
(Compound 10)                                    (Compound 11)
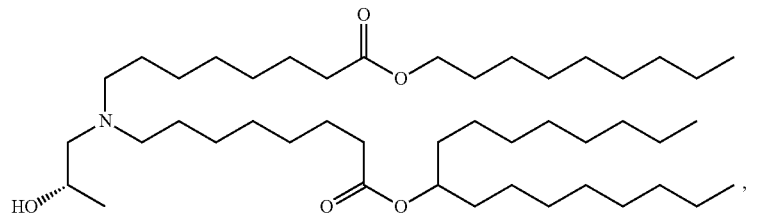
(Compound 12)
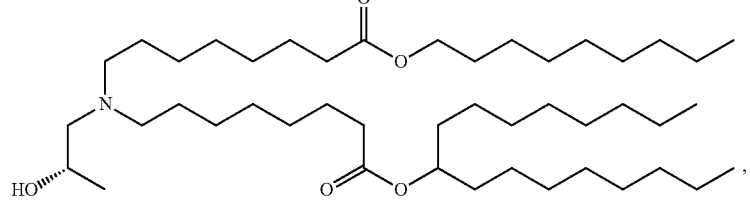
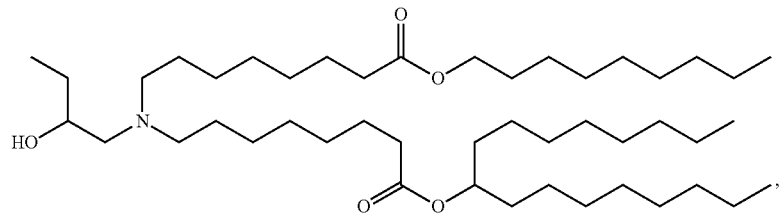
(Compound 13)
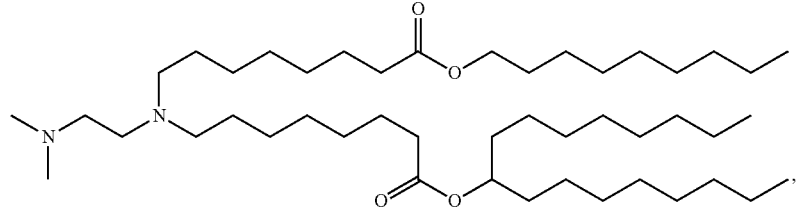
(Compound 14)

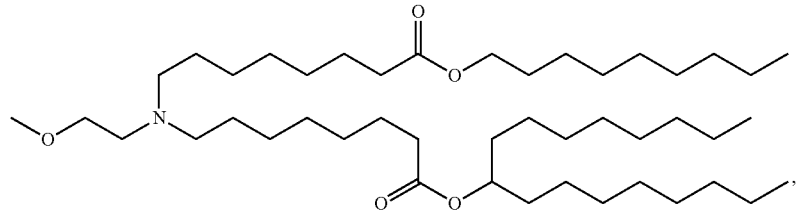
(Compound 15)
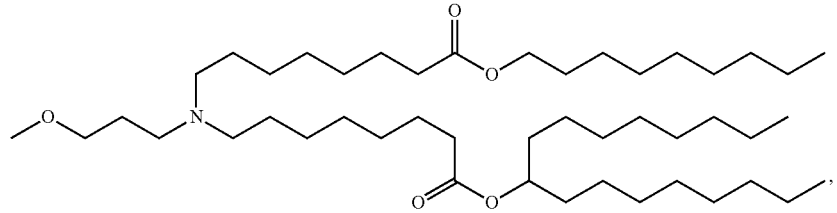
(Compound 16)
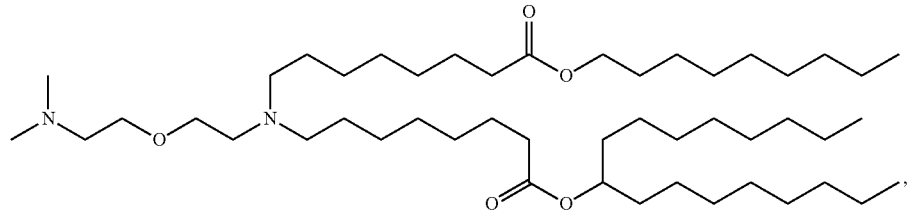
(Compound 17)
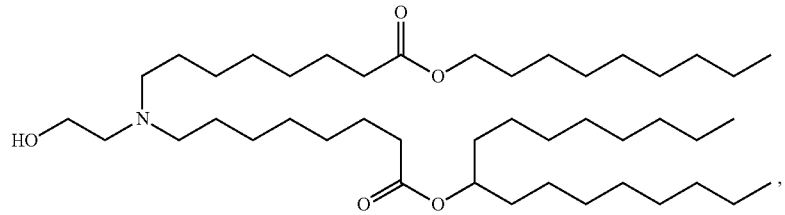
(Compound 18)
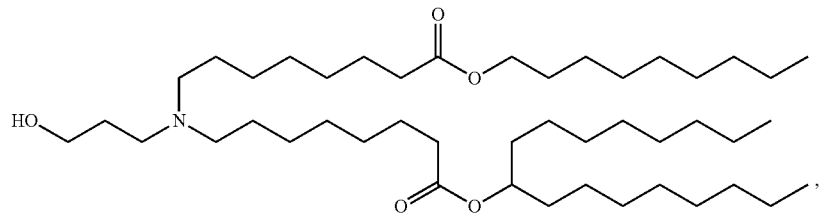
(Compound 19)
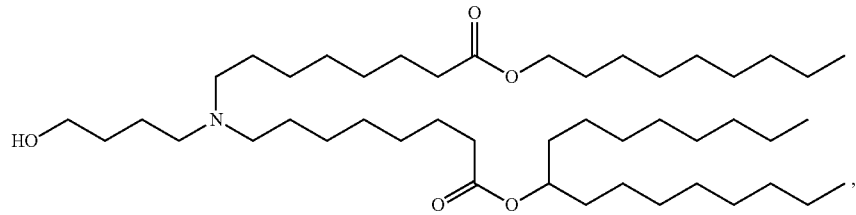
(Compound 20)
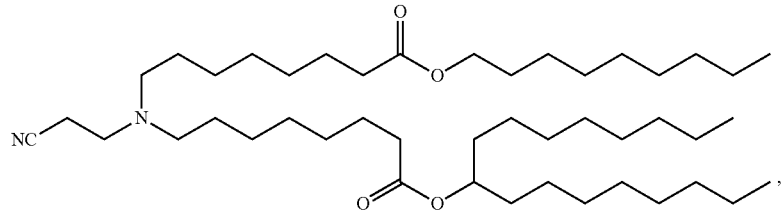
(Compound 21)

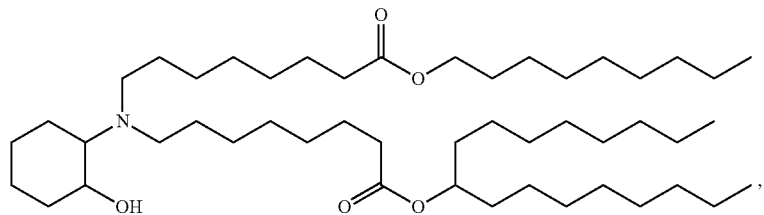
(Compound 22)
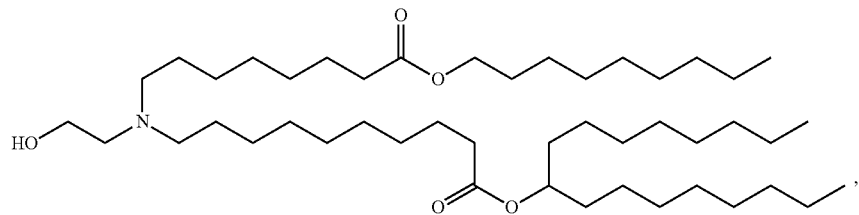
(Compound 23)
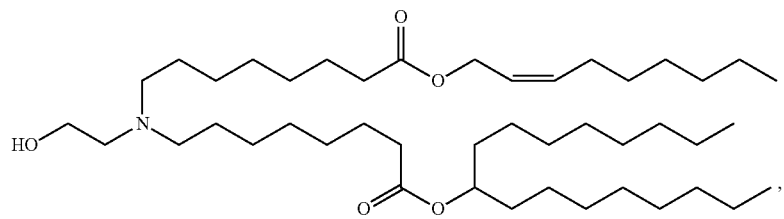
(Compound 24)
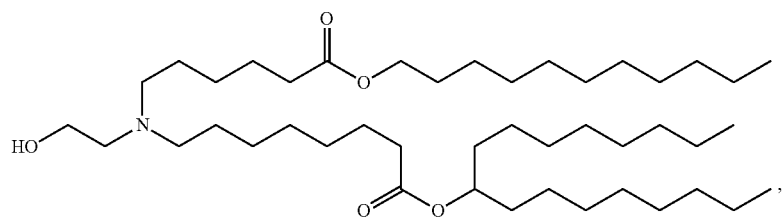
(Compound 25)
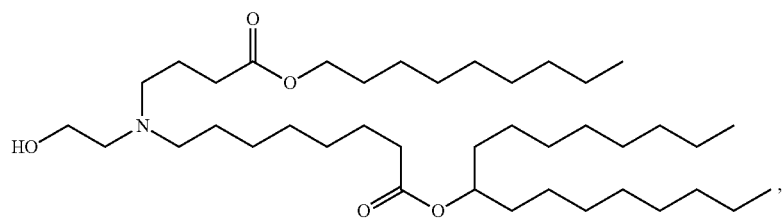
(Compound 26)
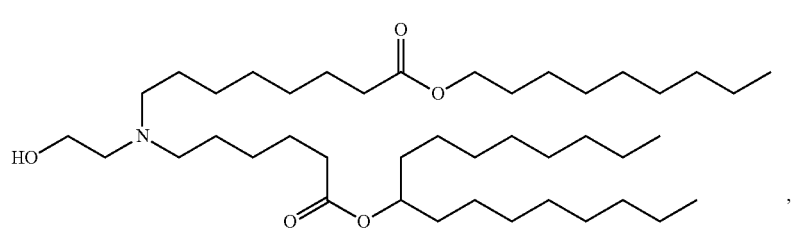
(Compound 27)
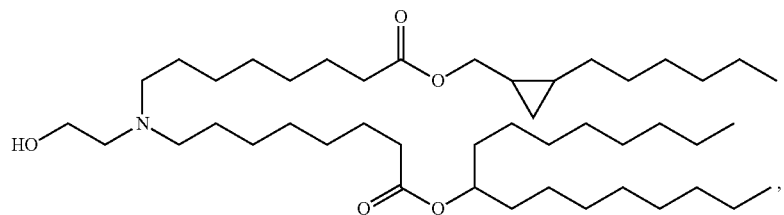
(Compound 28)

(Compound 29)
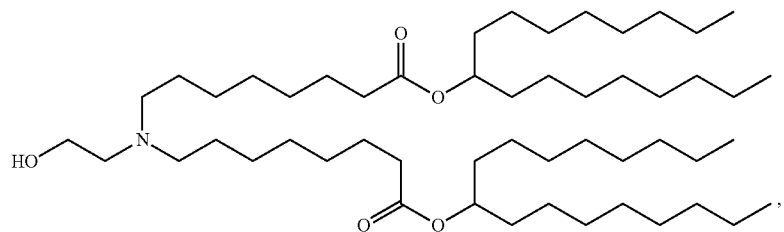
(Compound 30)
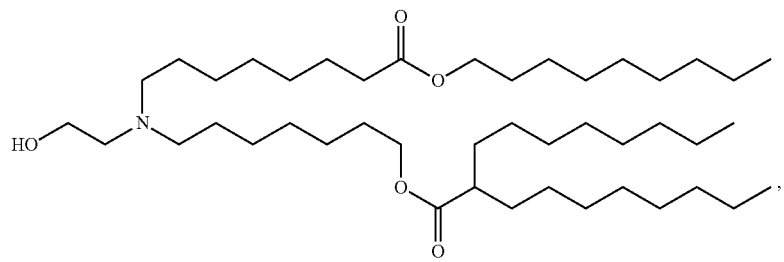
(Compound 31)
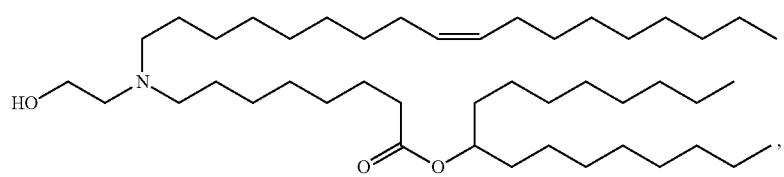
(Compound 32)
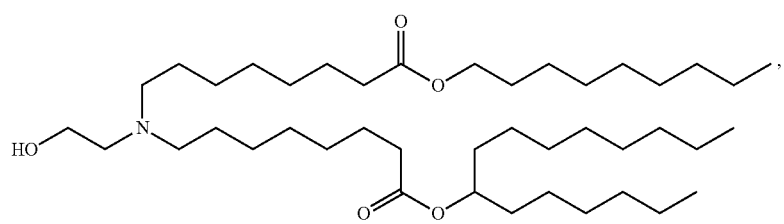
(Compound 33)
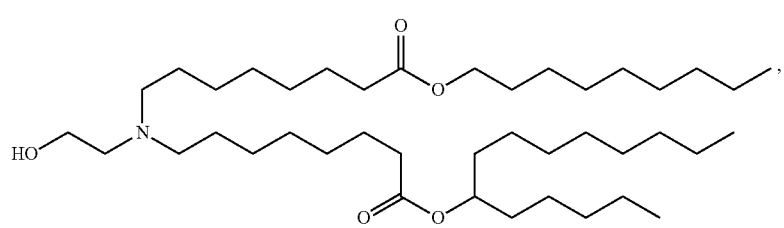
(Compound 34)
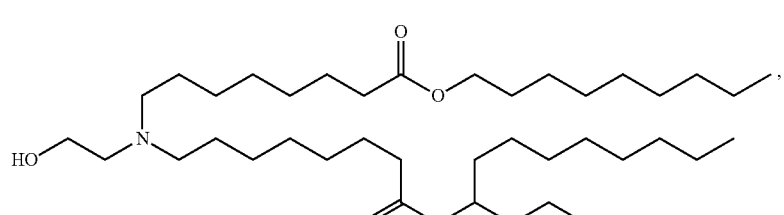
(Compound 35)
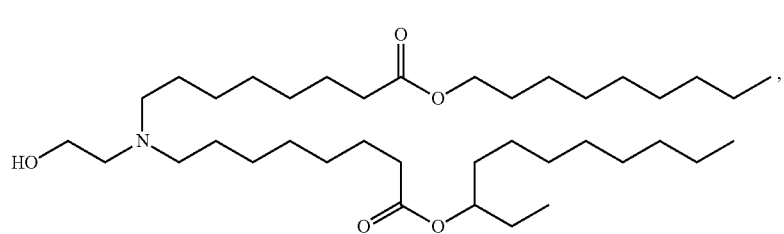

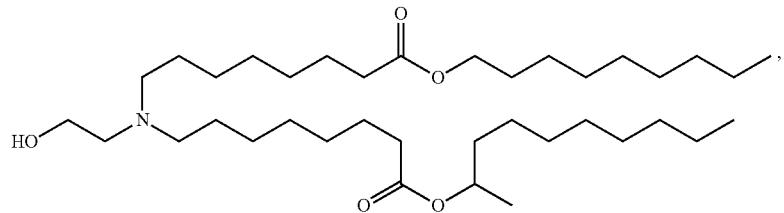
(Compound 36)
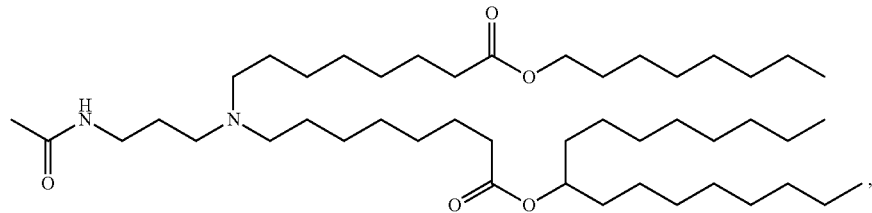
(Compound 37)
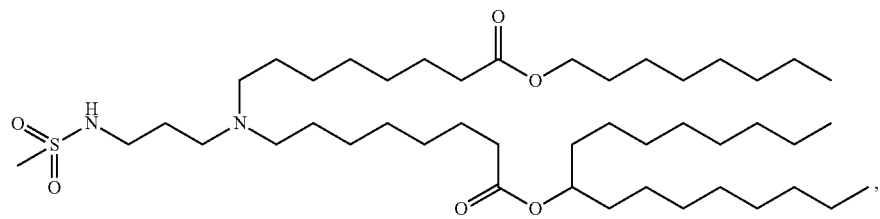
(Compound 38)
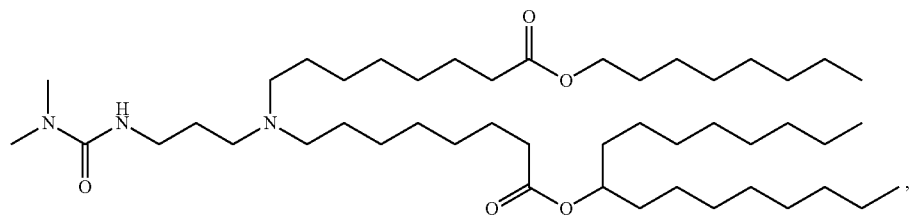
(Compound 39)
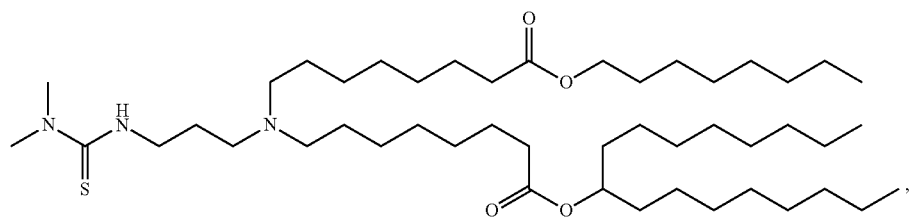
(Compound 40)
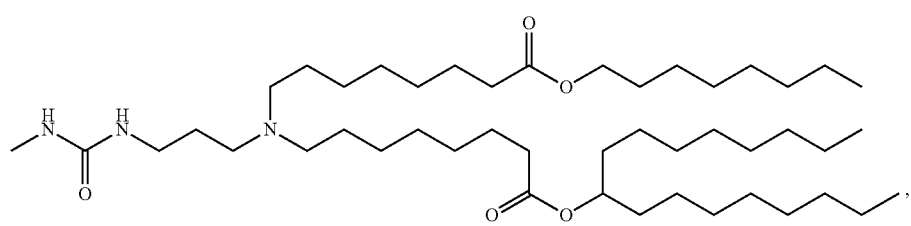
(Compound 41)
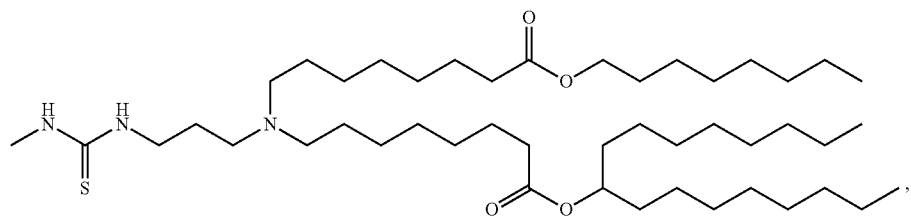
(Compound 42)

(Compound 43)
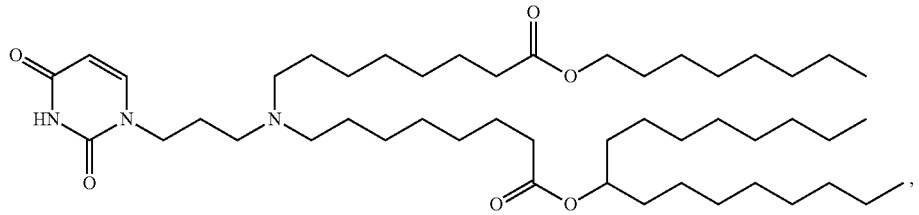
(Compound 44)
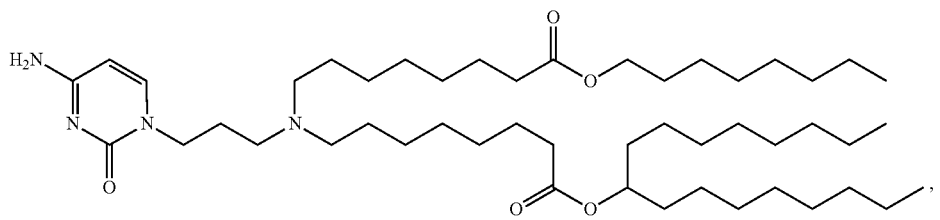
(Compound 45)
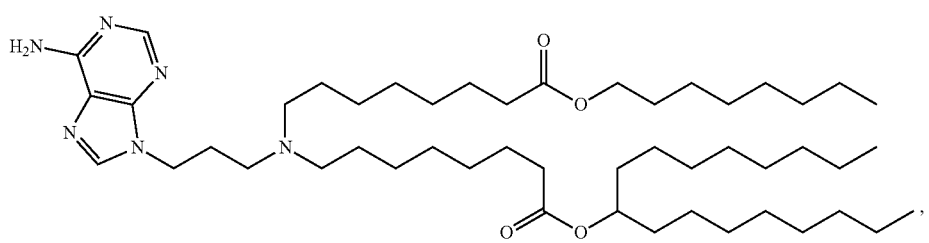
(Compound 46)
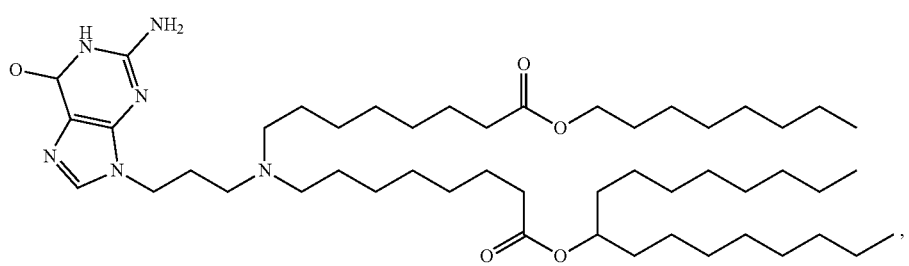
(Compound 47)
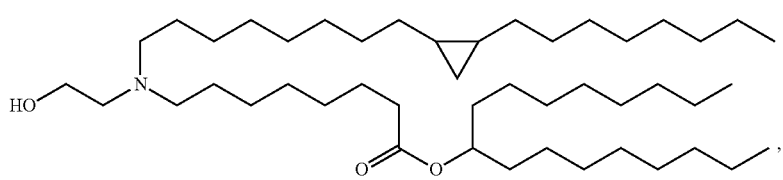
(Compound 48)
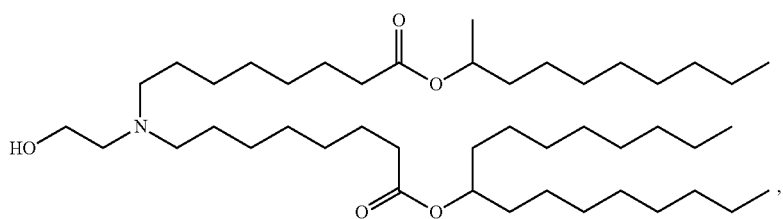
(Compound 49)
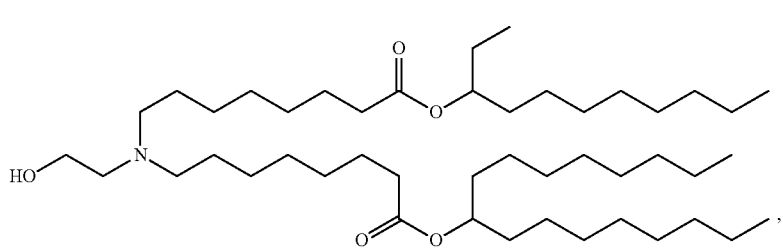

(Compound 50)
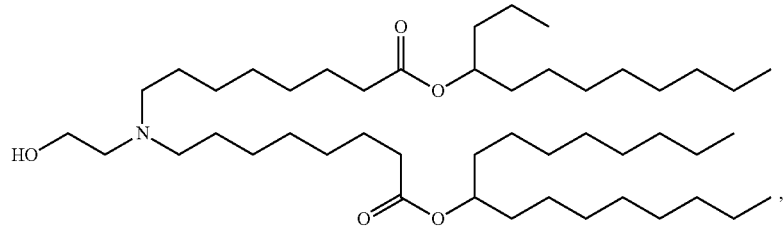
(Compound 51)
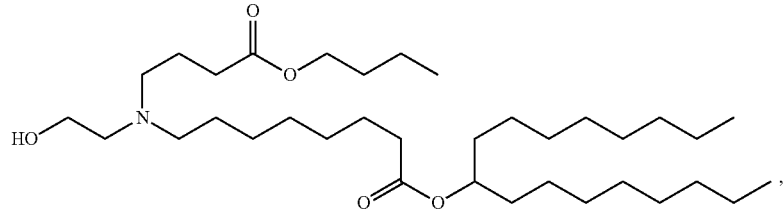
(Compound 52)
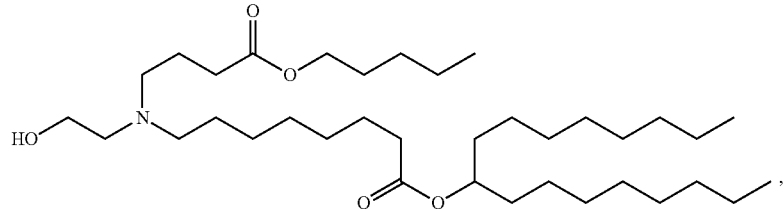
(Compound 53)
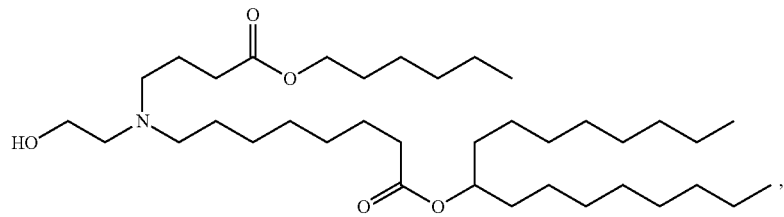
(Compound 54)
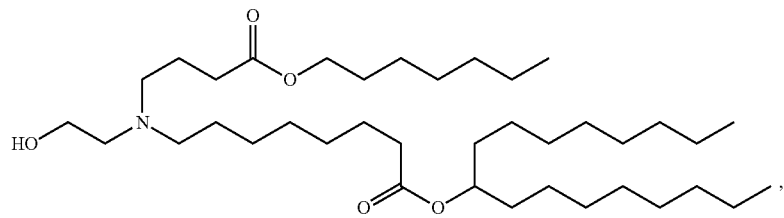
(Compound 55)
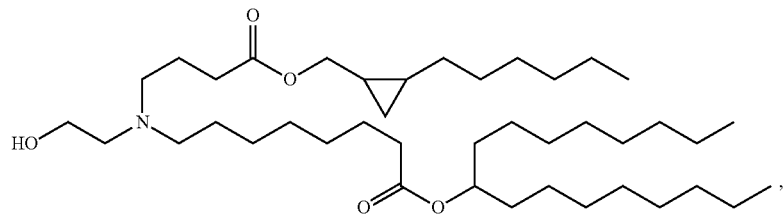
(Compound 56)
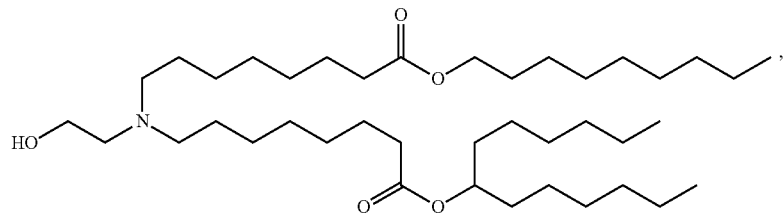

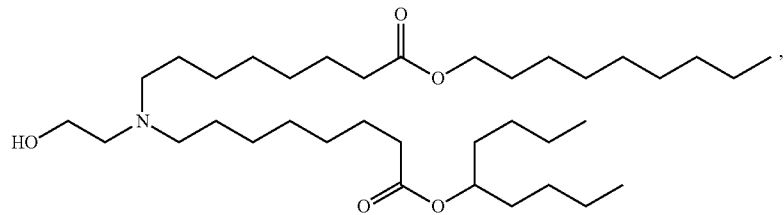
(Compound 57)
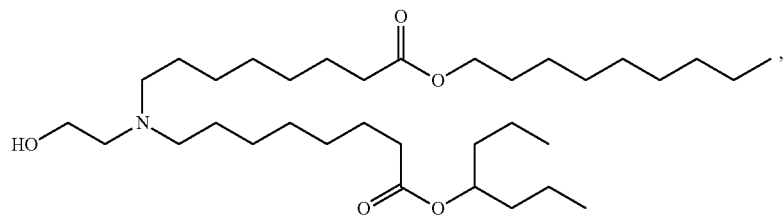
(Compound 58)
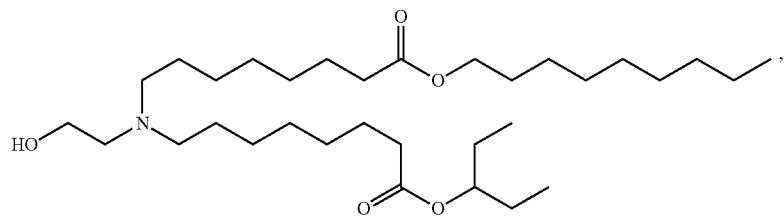
(Compound 59)
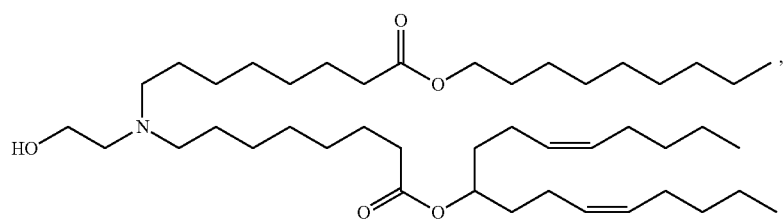
(Compound 60)
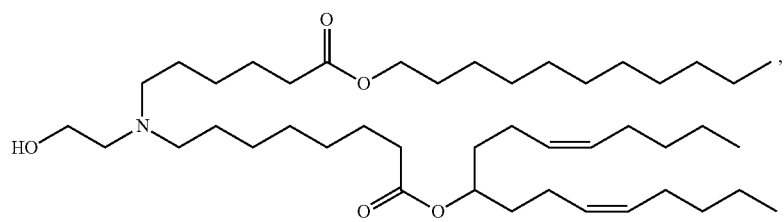
(Compound 61)
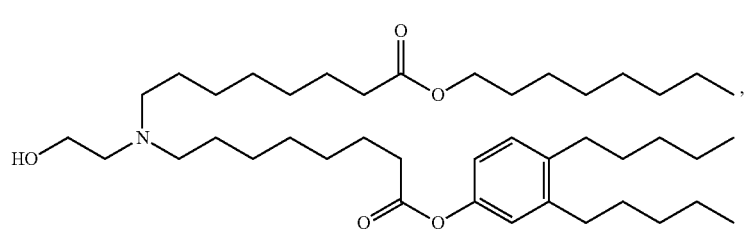
(Compound 62)
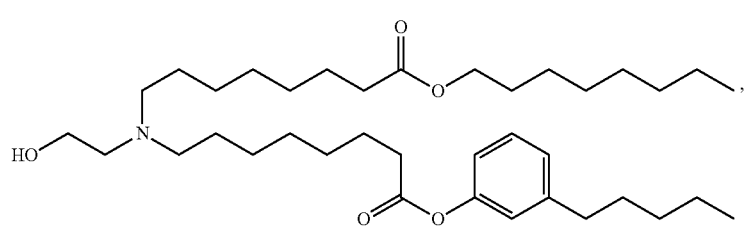
(Compound 63)

(Compound 64)
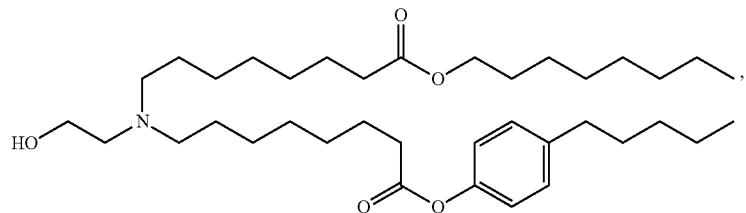
(Compound 65)
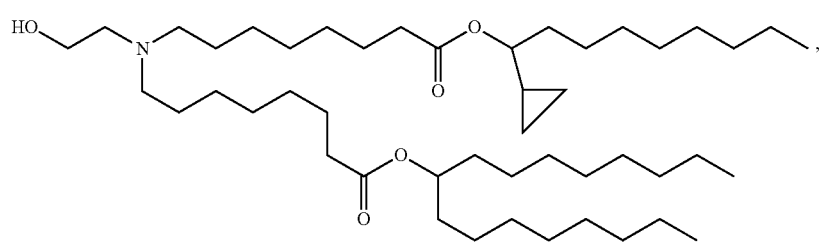
(Compound 66)
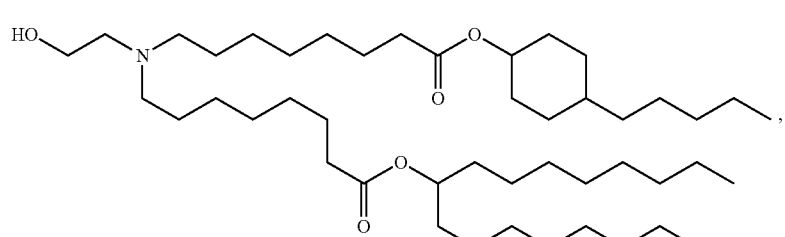
| (Compound 67) | (Compound 68) |
|---|---|
| 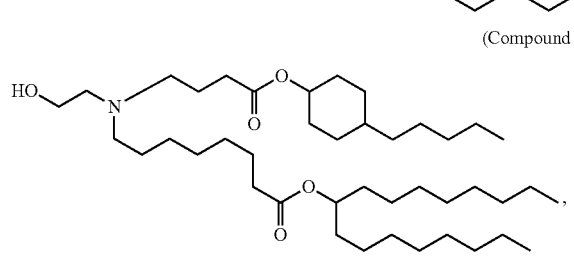 | 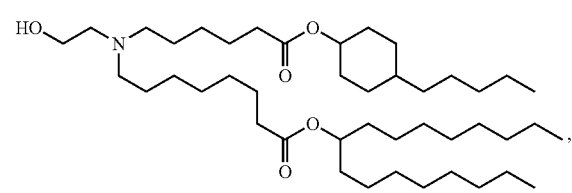 |
(Compound 69)
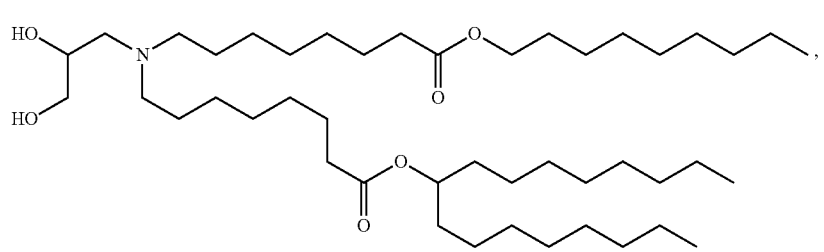
| (Compound 70) | (Compound 71) |
|---|---|
| 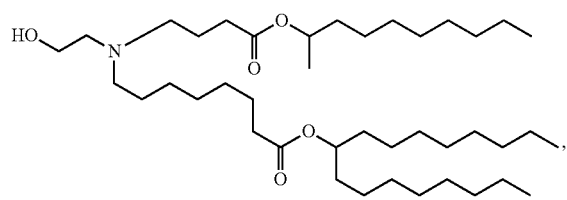 | 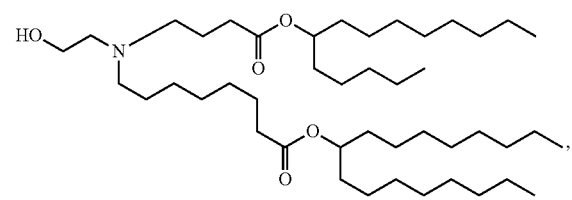 |
| (Compound 72) | (Compound 73) |
|---|---|
| 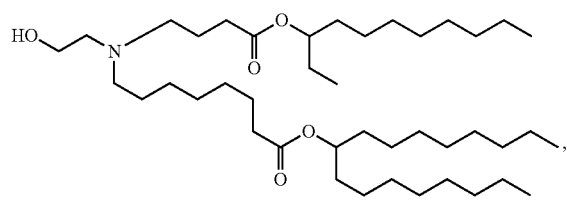 | 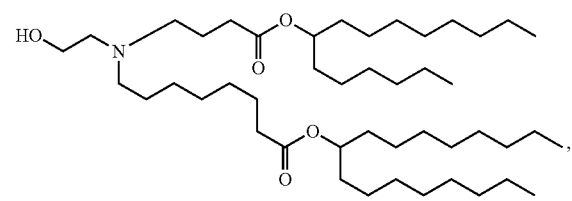 |

-continued
(Compound 74)
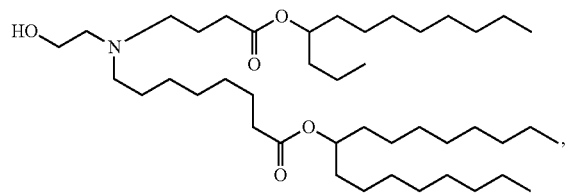
(Compound 75)
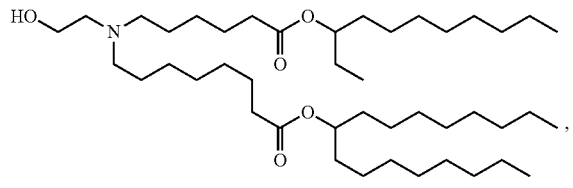
(Compound 76)
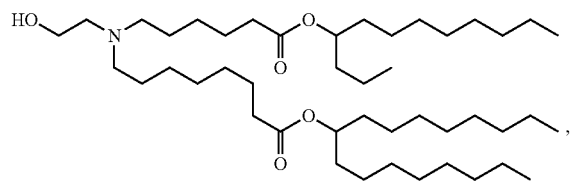
(Compound 77)
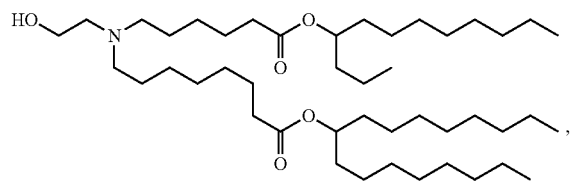
(Compound 78)
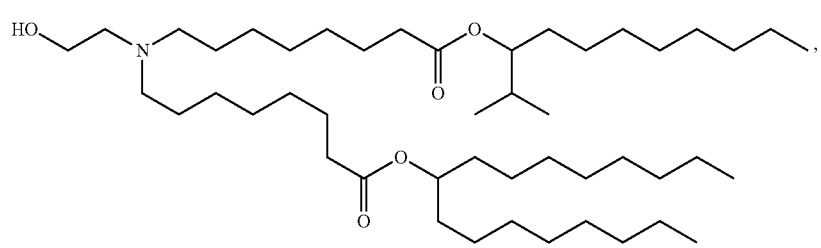
(Compound 79)
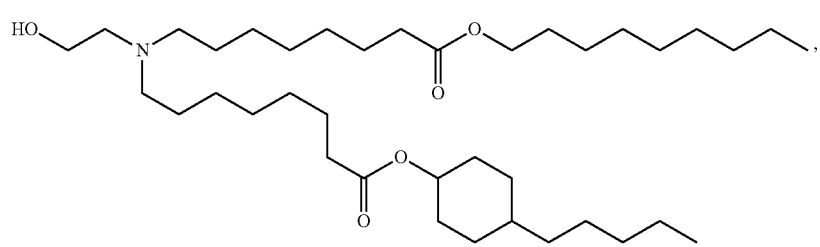
(Compound 80)
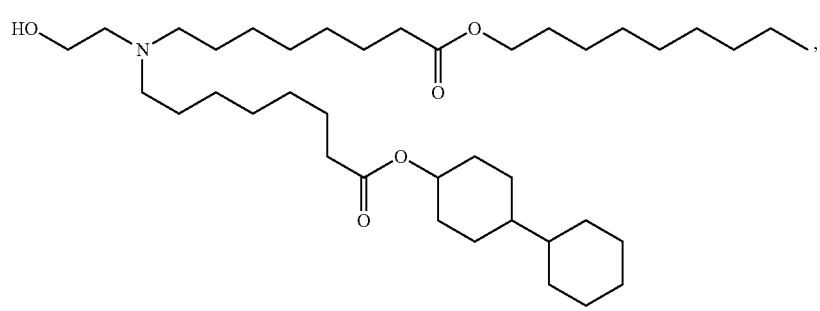
(Compound 81)
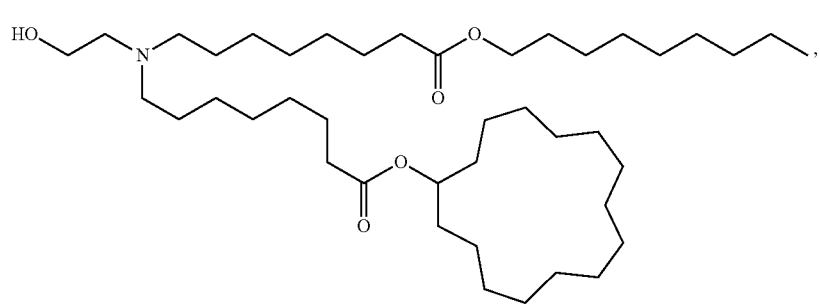

-continued
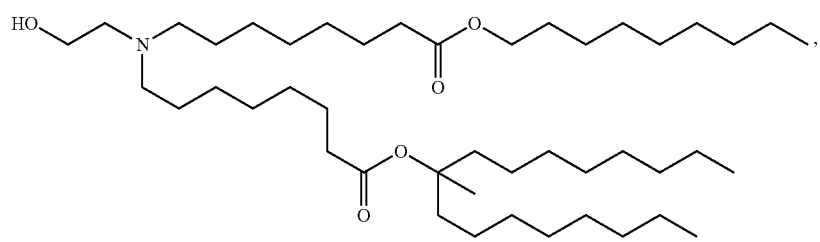
(Compound 82)
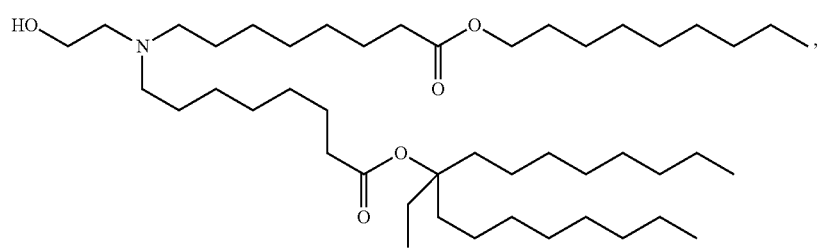
(Compound 83)
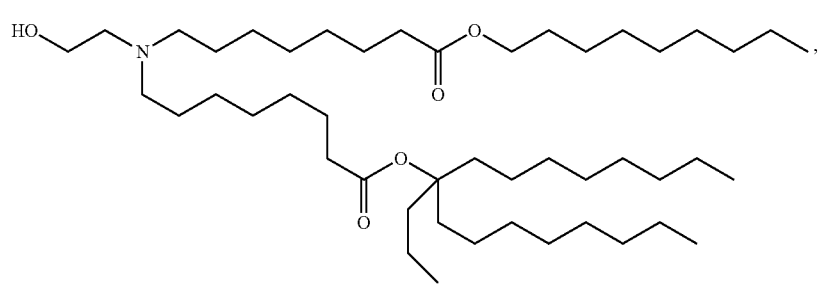
(Compound 84)
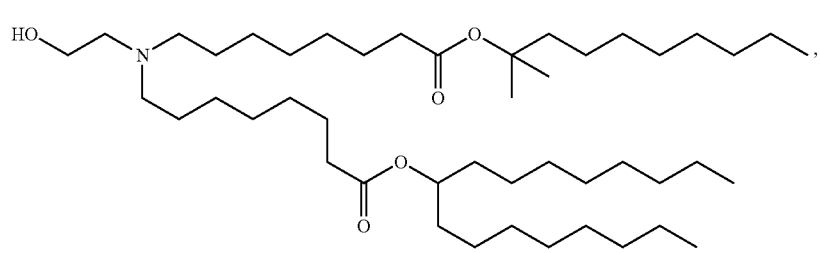
(Compound 85)
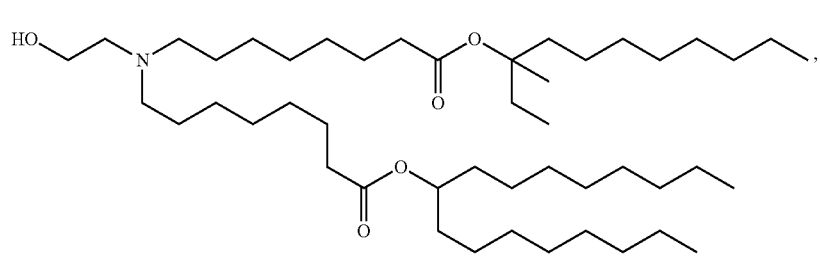
(Compound 86)
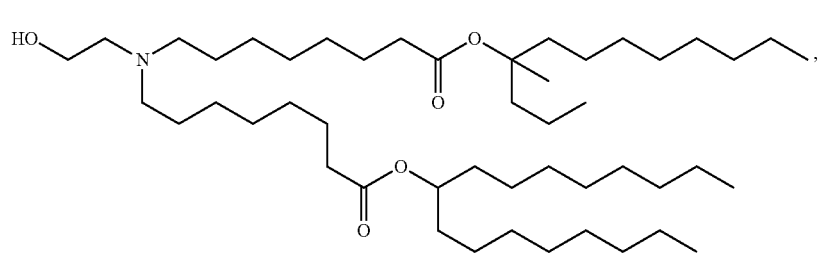
(Compound 87)

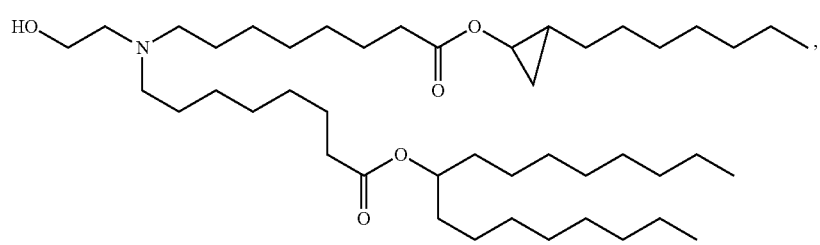
(Compound 88)
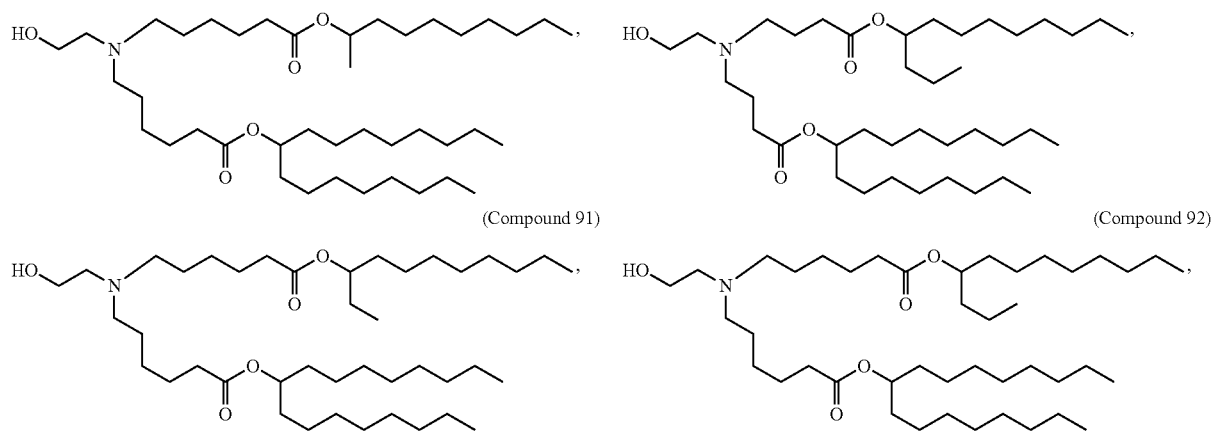
(Compound 89) (Compound 90) (Compound 91) (Compound 92)
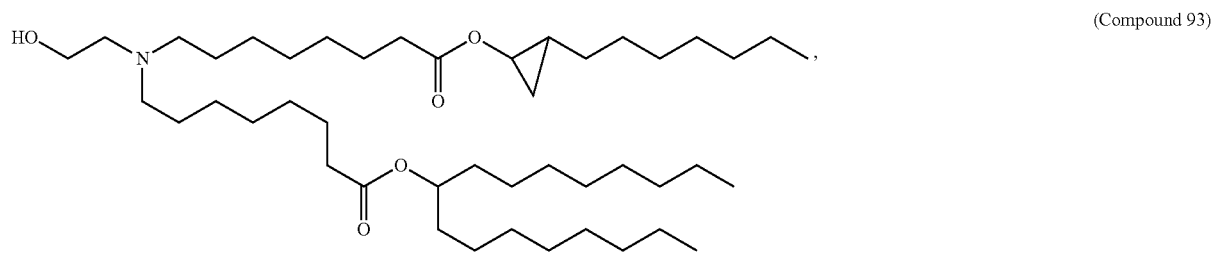
(Compound 93)
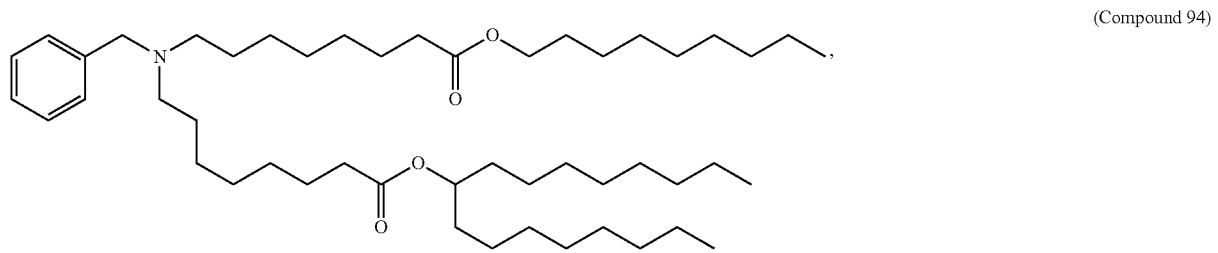
(Compound 94)
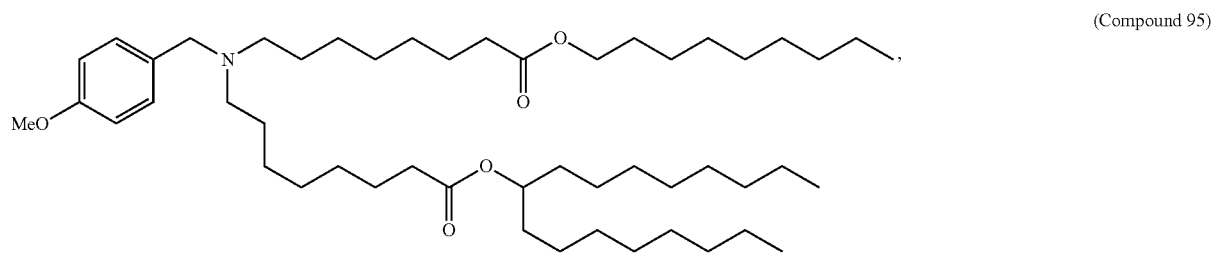
(Compound 95)

-continued
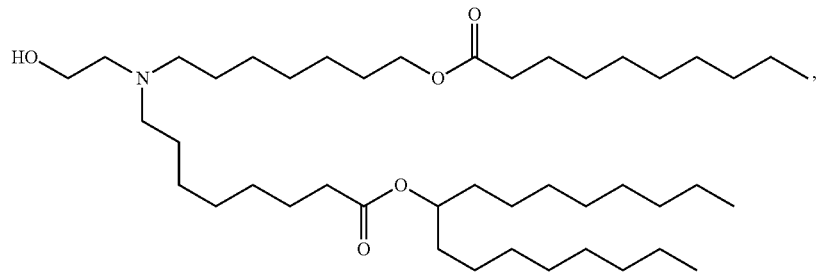
(Compound 96)
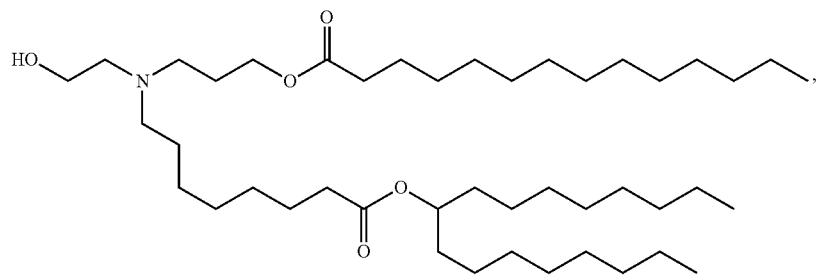
(Compound 97)
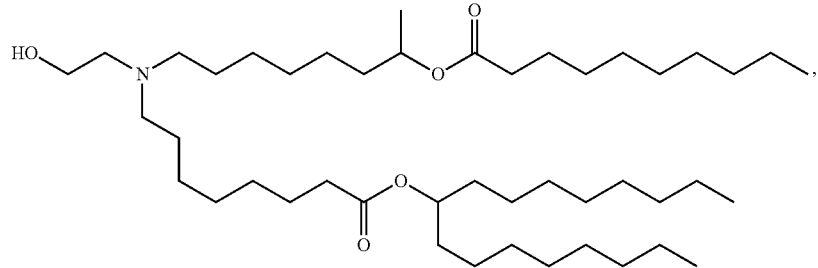
(Compound 98)
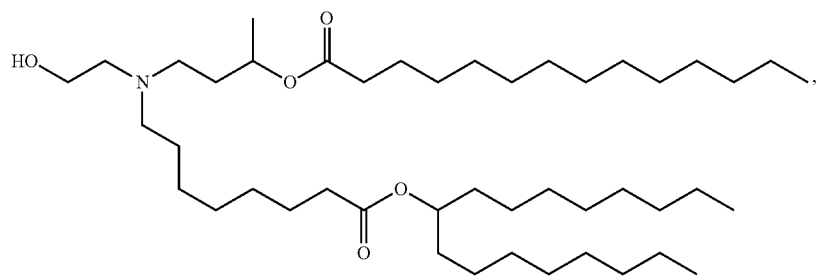
(Compound 99)
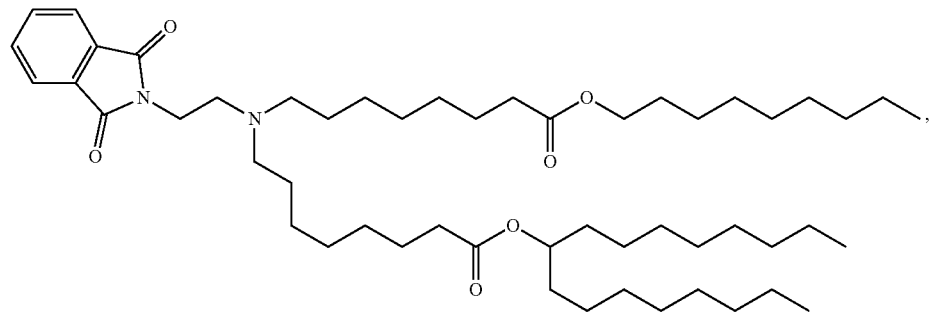
(Compound 100)

-continued
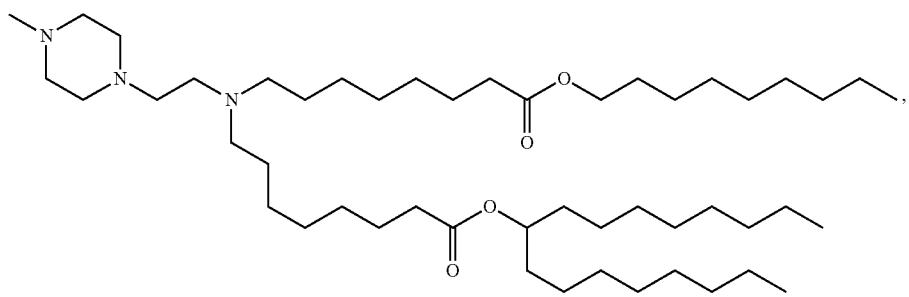
(Compound 101)
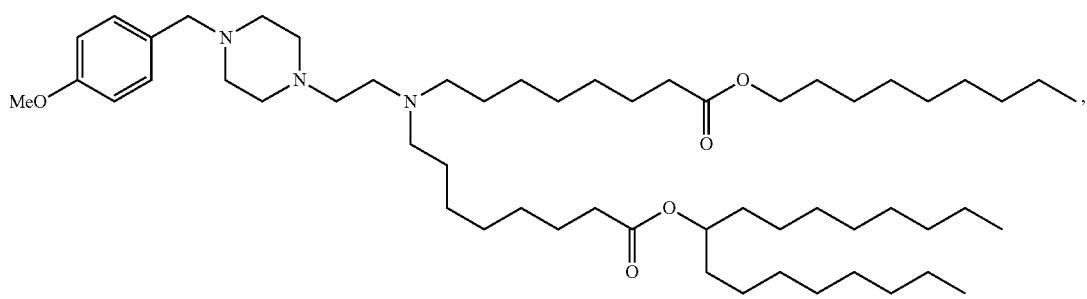
(Compound 102)
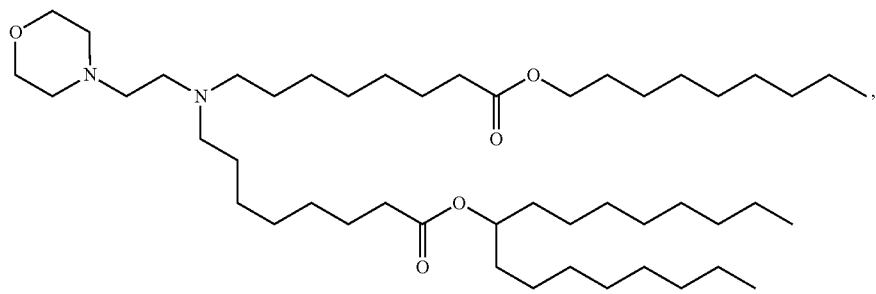
(Compound 103)
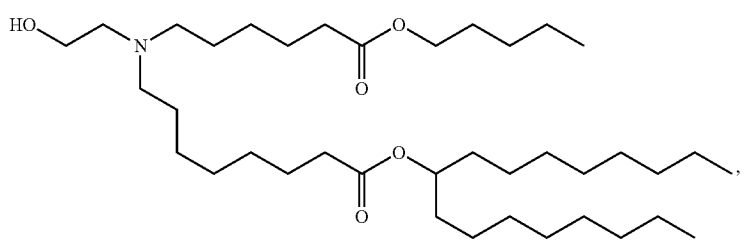
(Compound 104)
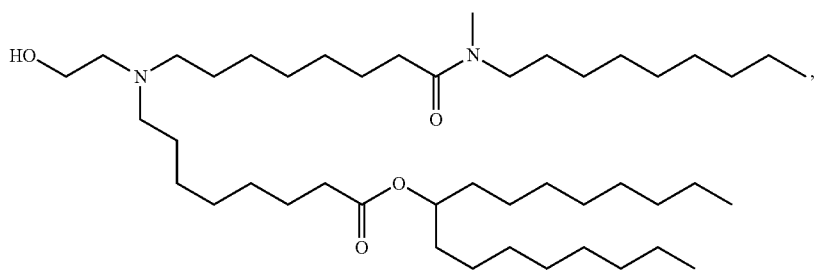
(Compound 105)

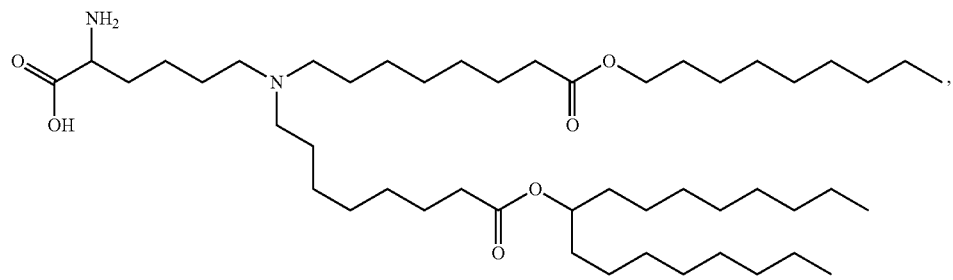
(Compound 106)
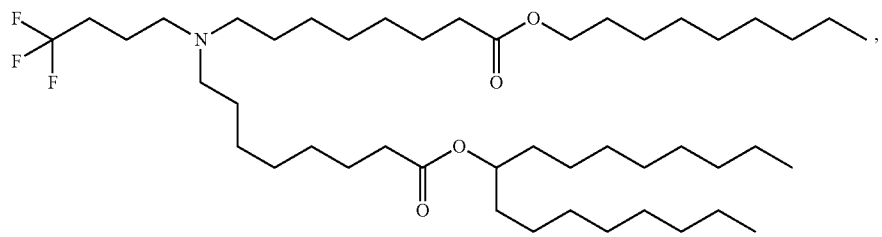
(Compound 107)
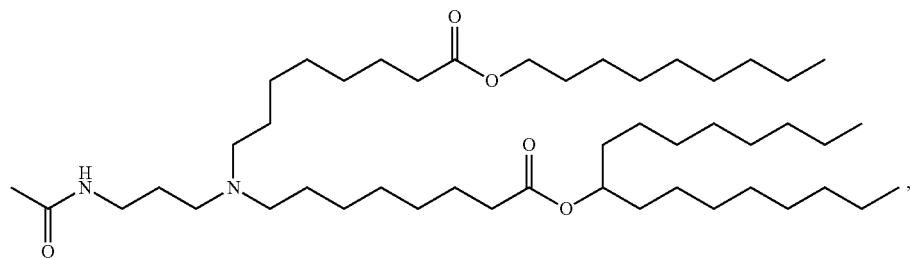
(Compound 108)
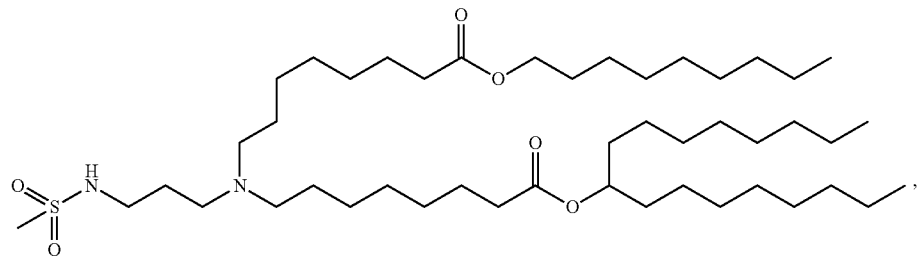
(Compound 109)
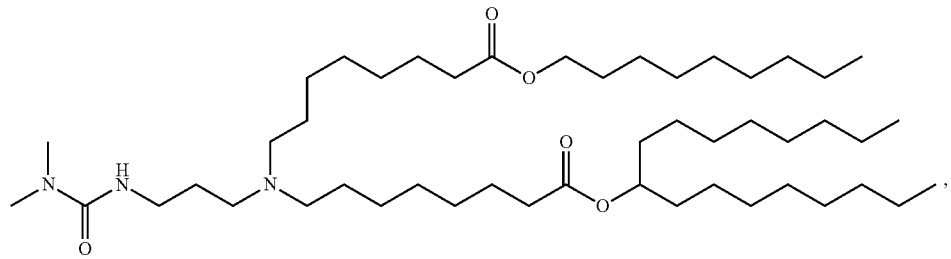
(Compound 110)
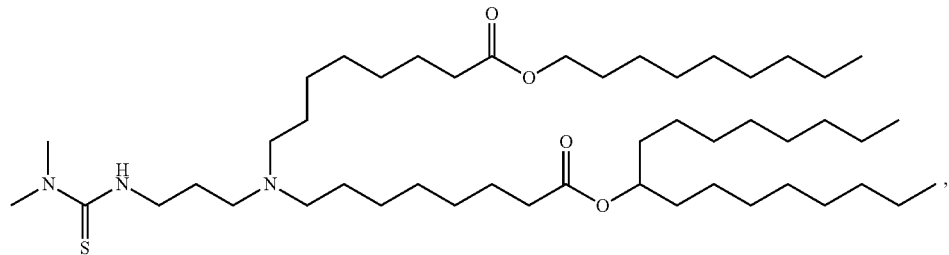
(Compound 111)

(Compound 112)
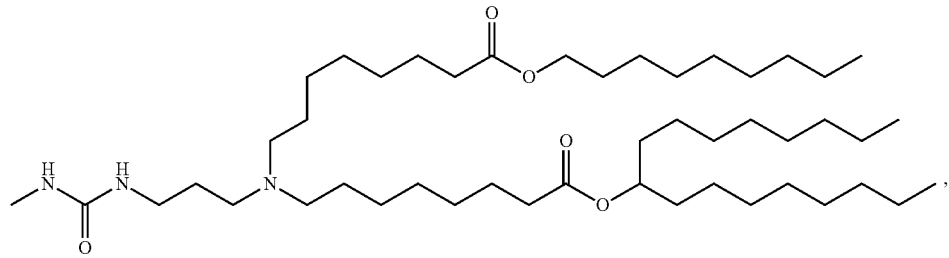
(Compound 113)
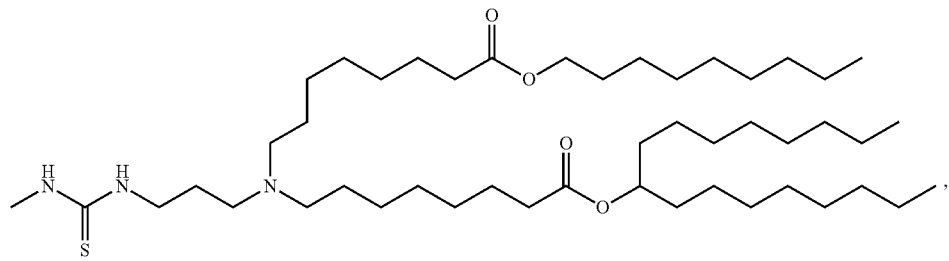
(Compound 114)
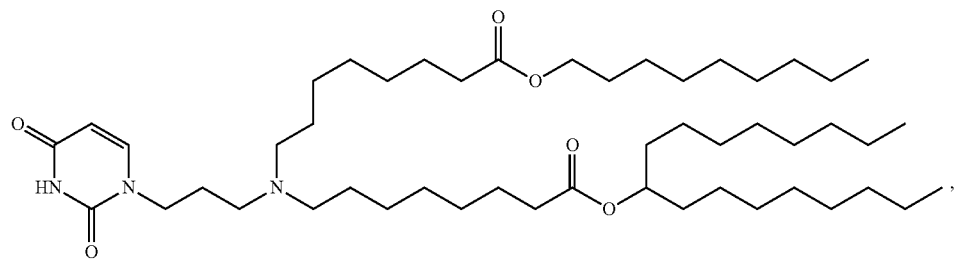
(Compound 115)
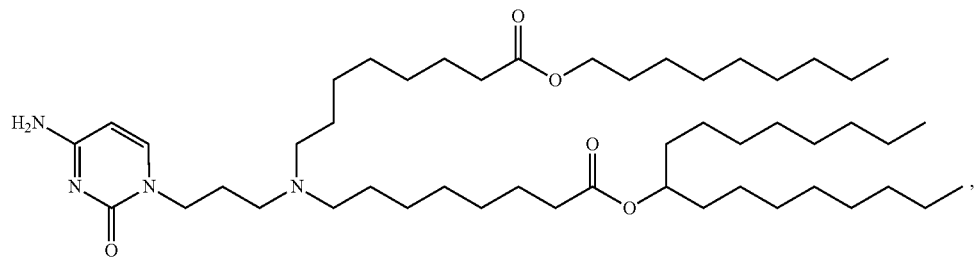
(Compound 116)
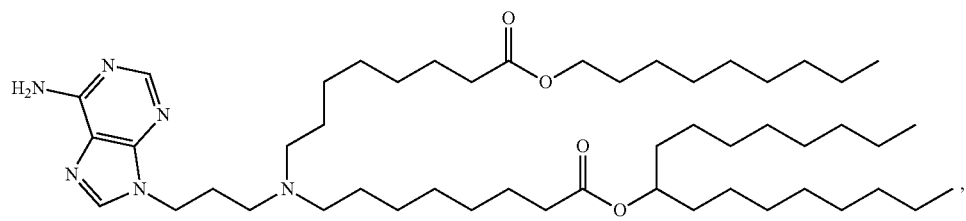
(Compound 117)
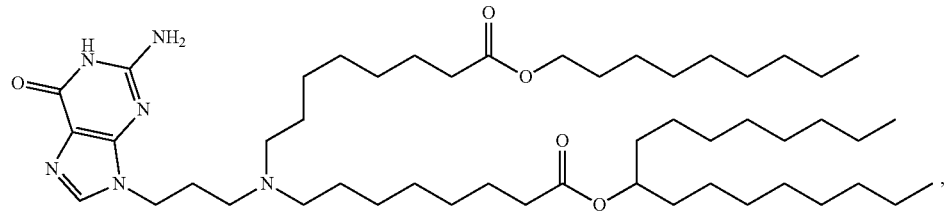

-continued
(Compound 118)
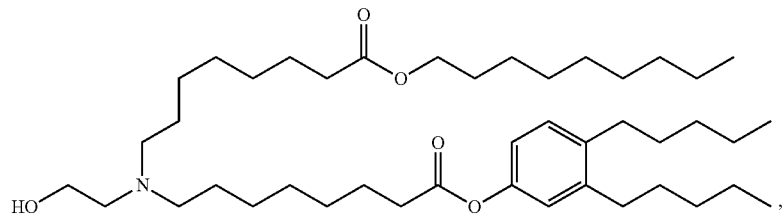
(Compound 119)
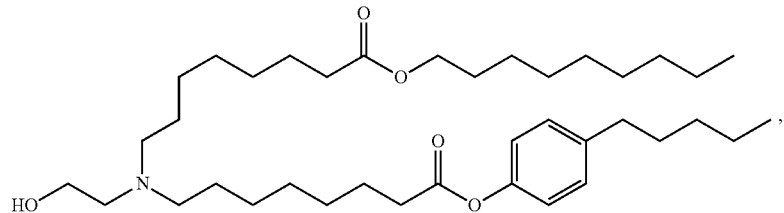
(Compound 120)
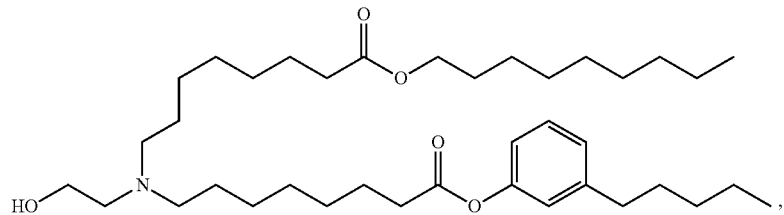
(Compound 121)
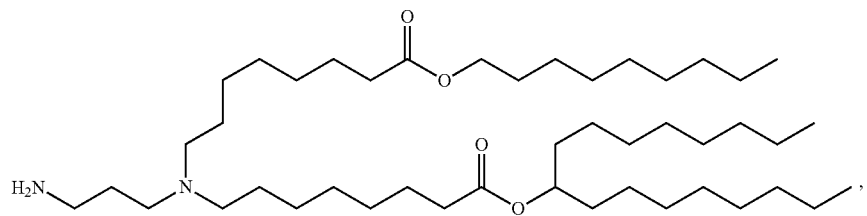
(Compound 122)
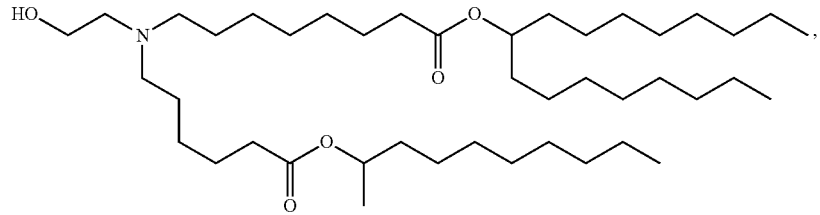
(Compound 123)
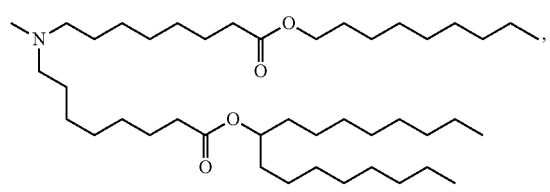
(Compound 124)
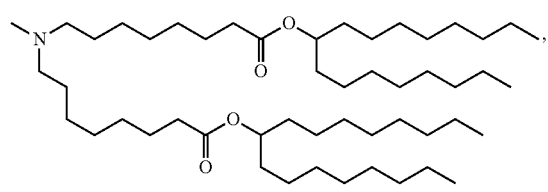
(Compound 125)
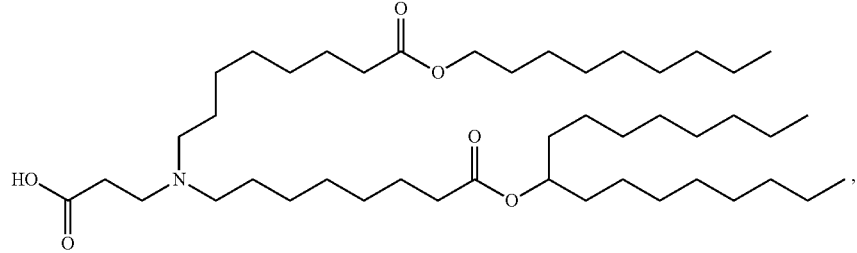

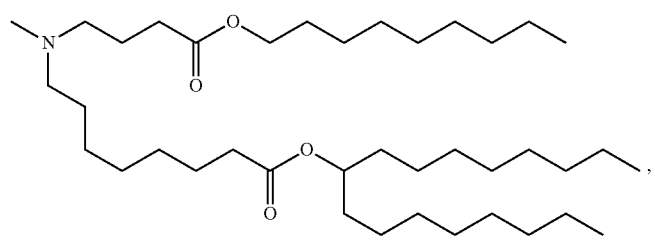
(Compound 126)
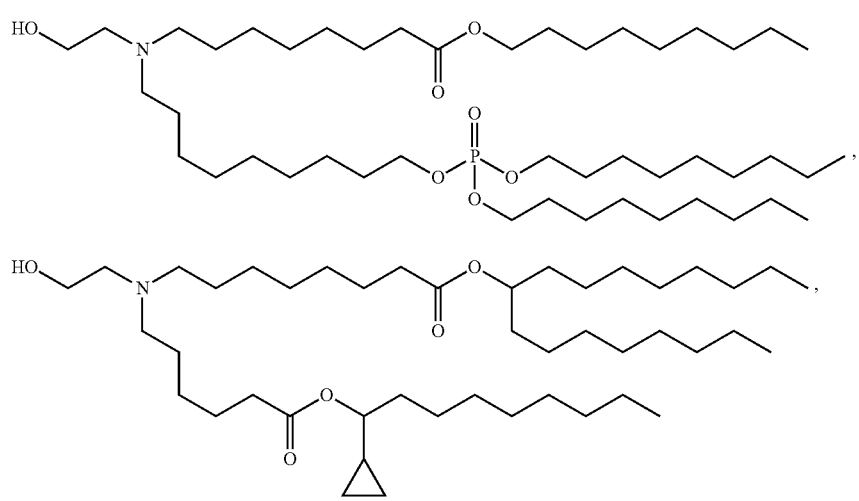
(Compound 127)
(Compound 128)
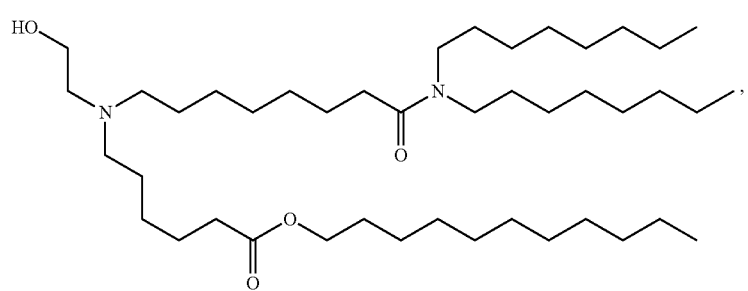
(Compound 129)
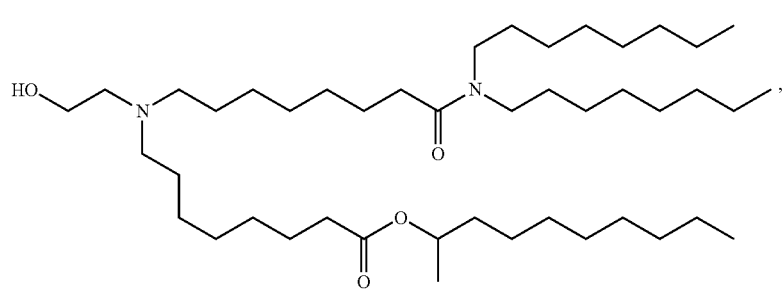
(Compound 130)
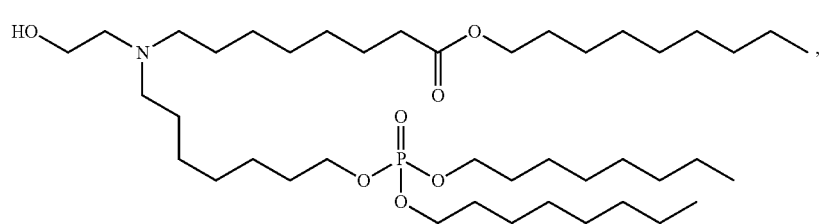
(Compound 131)

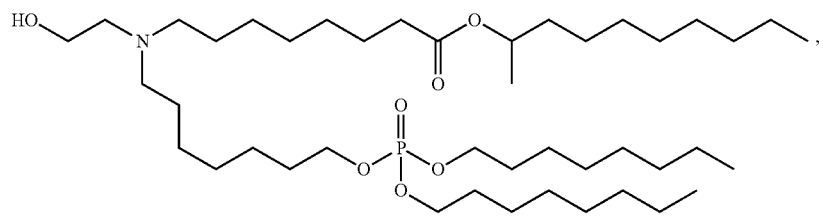
(Compound 132)
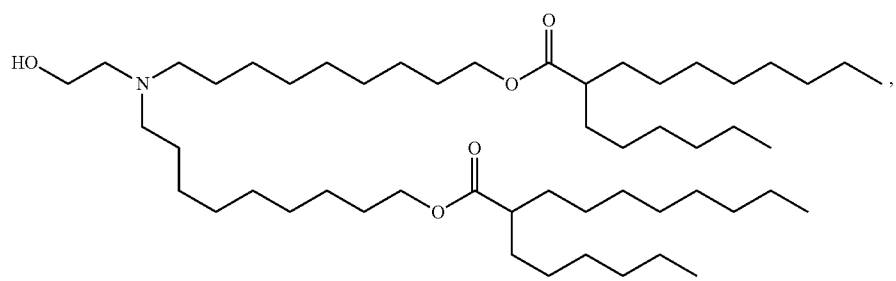
(Compound 133)
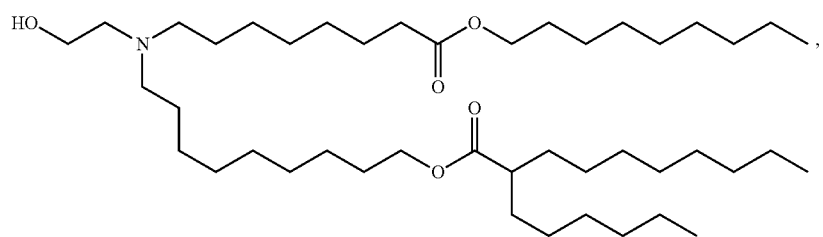
(Compound 134)
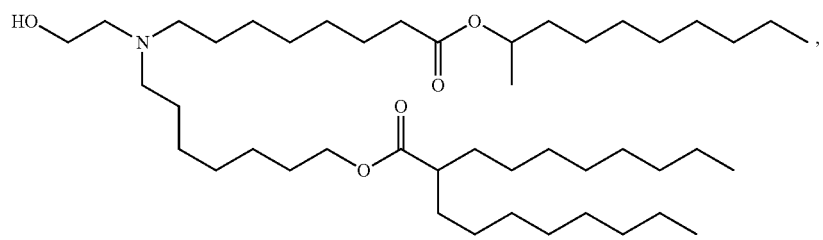
(Compound 135)
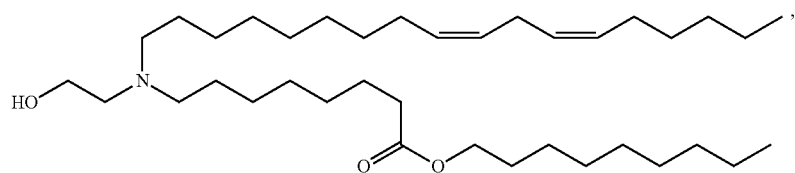
(Compound 136)
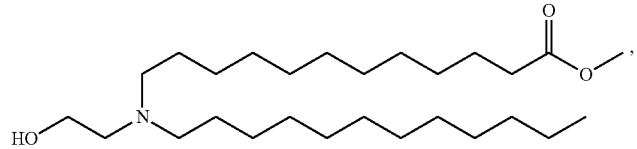
(Compound 137)
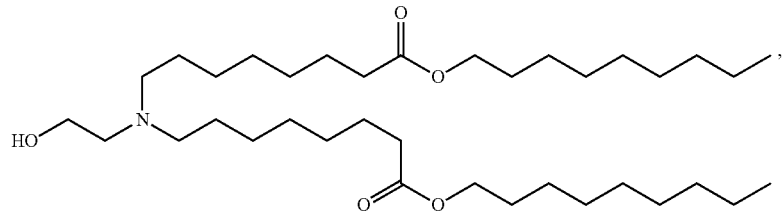
(Compound 138)

-continued
(Compound 139)
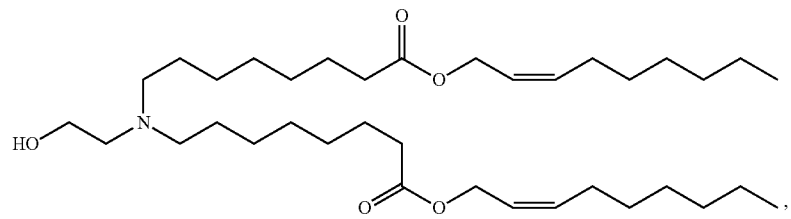
(Compound 140)
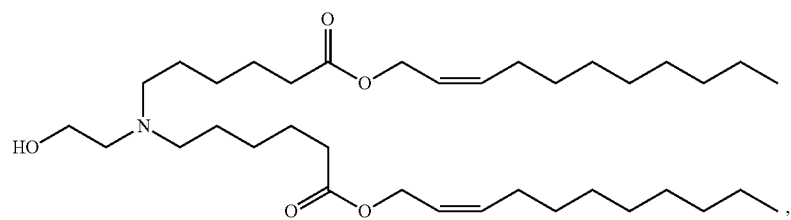
(Compound 141)
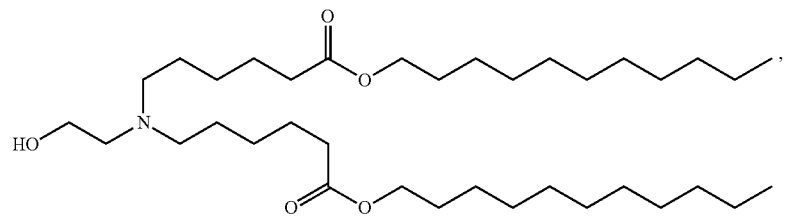
(Compound 142)
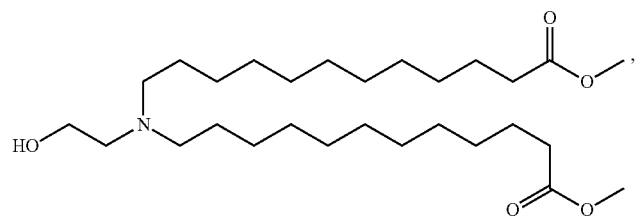
(Compound 143)
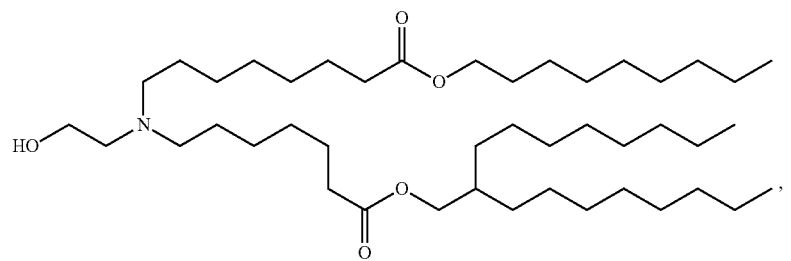
(Compound 144)
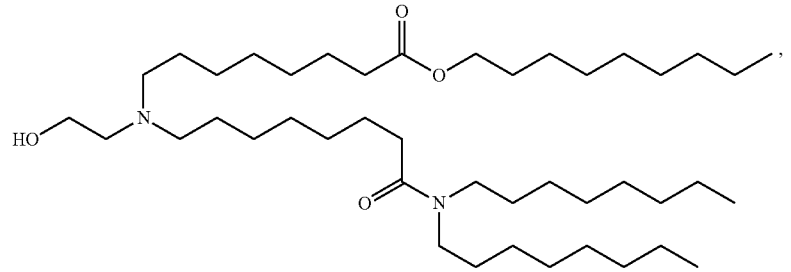

-continued
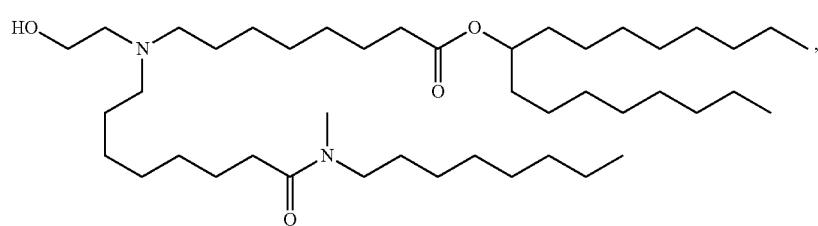
(Compound 145)
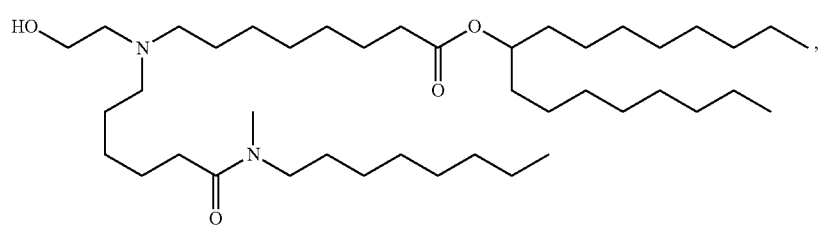
(Compound 146)
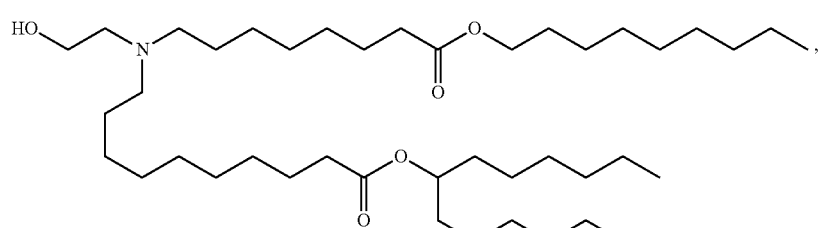
(Compound 147)
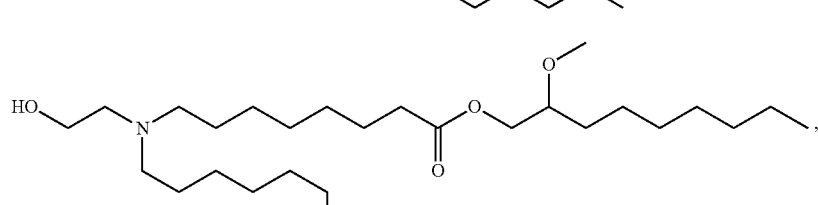
(Compound 148)
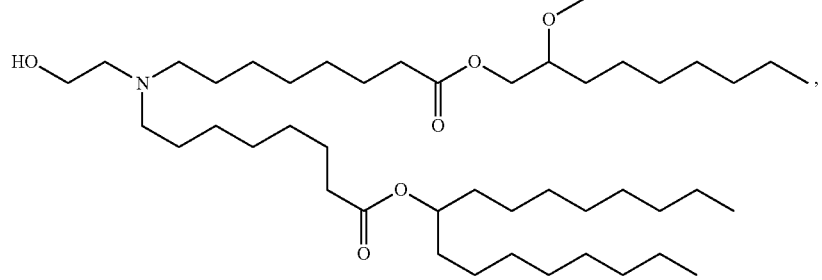
(Compound 149)
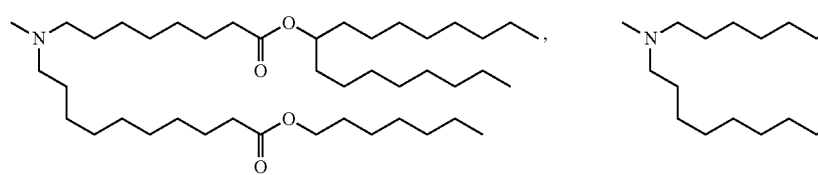
(Compound 150)
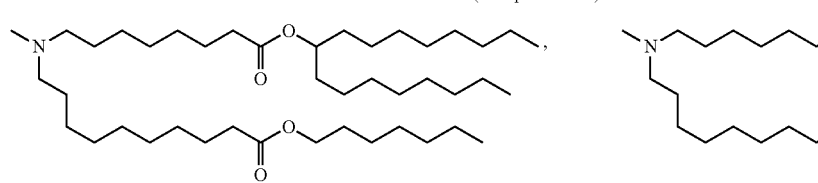
(Compound 151)
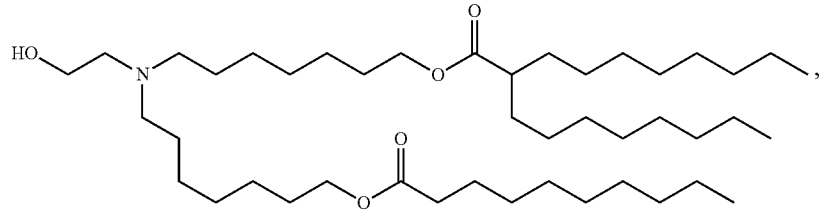
(Compound 152)
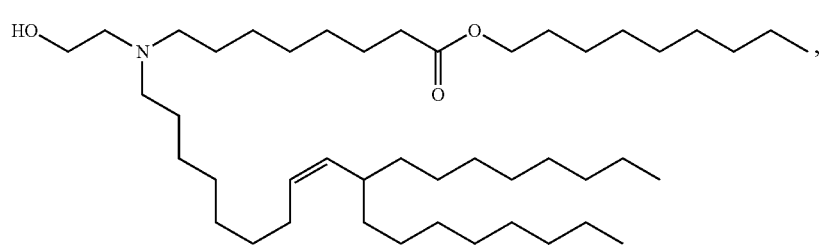

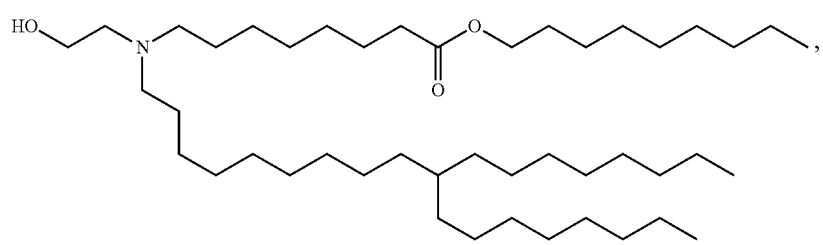
(Compound 153)
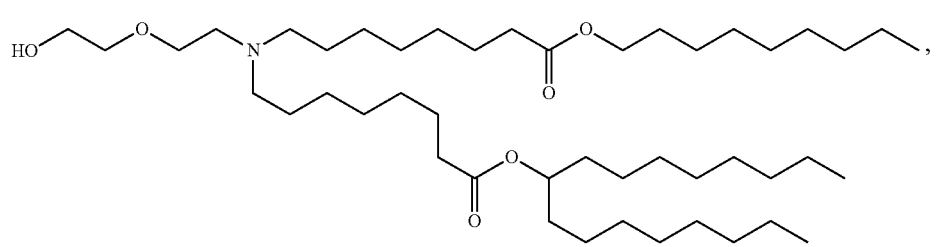
(Compound 154)
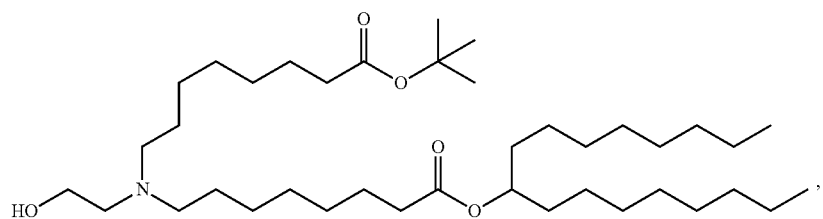
(Compound 155)
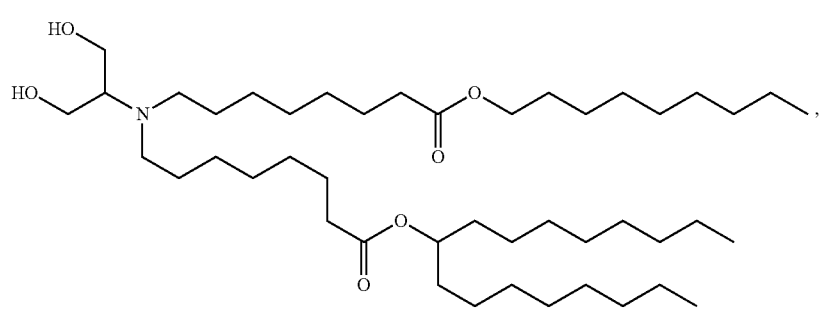
(Compound 156)
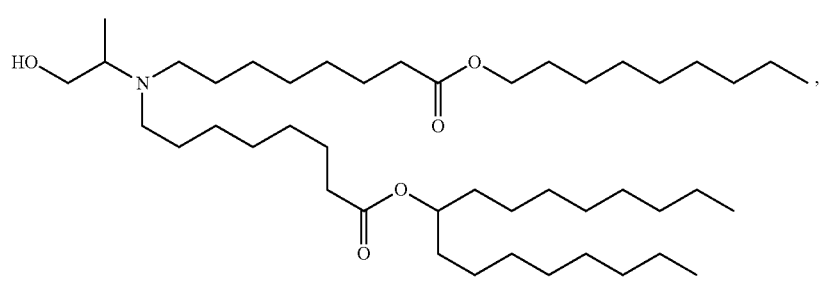
(Compound 157)
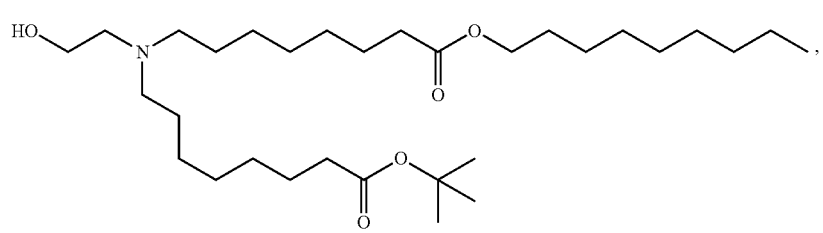
(Compound 158)

-continued
(Compound 159)
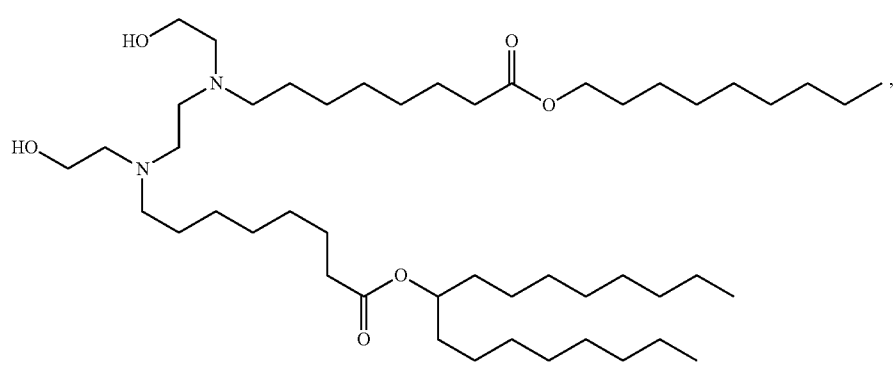
(Compound 160)
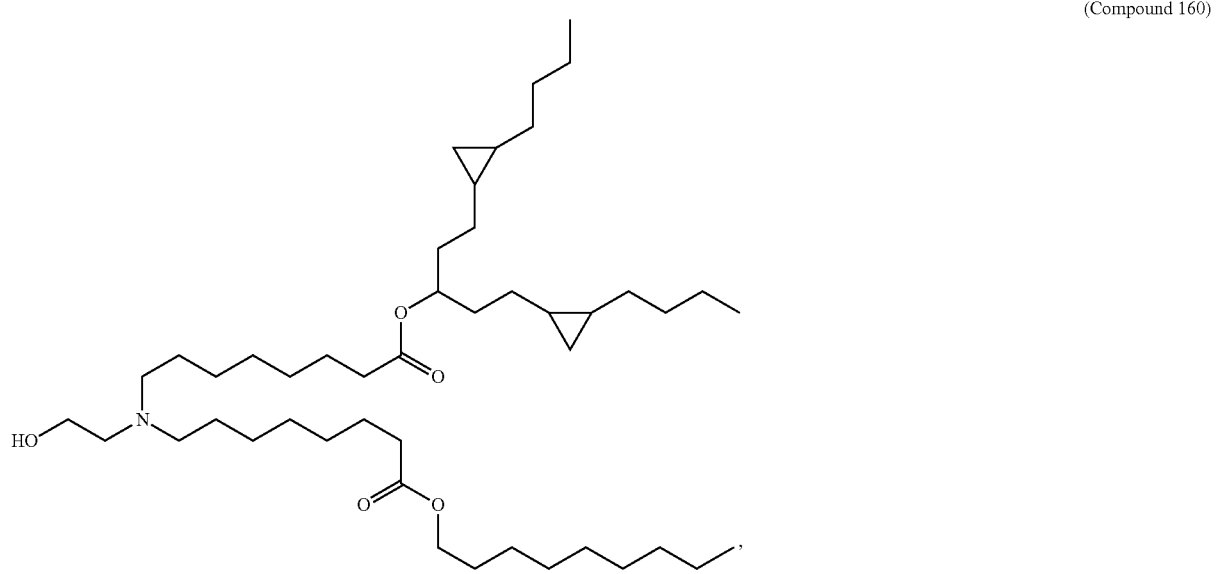
(Compound 161)
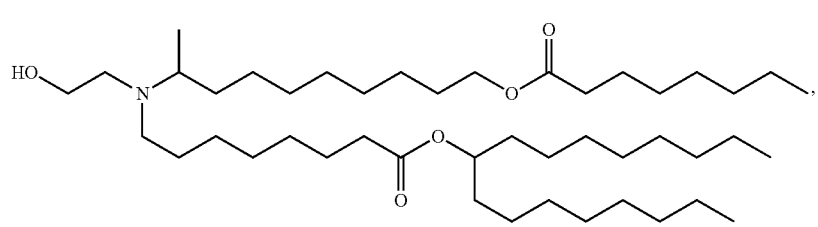
(Compound 162)
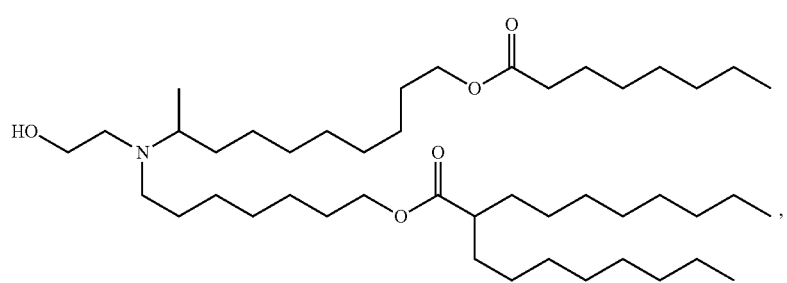

-continued
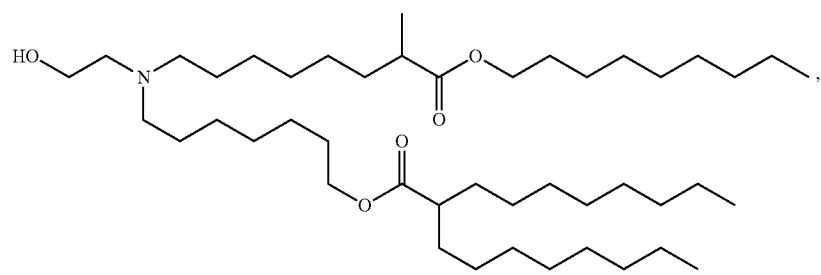
(Compound 163)
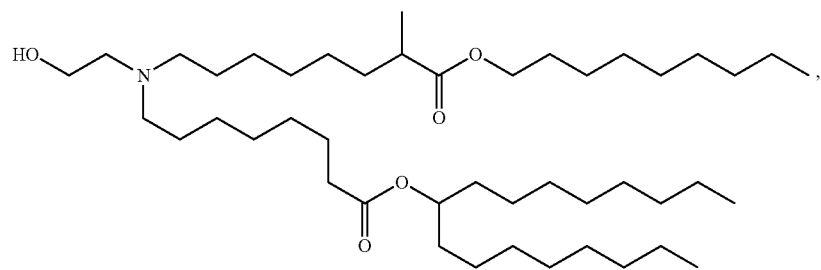
(Compound 164)
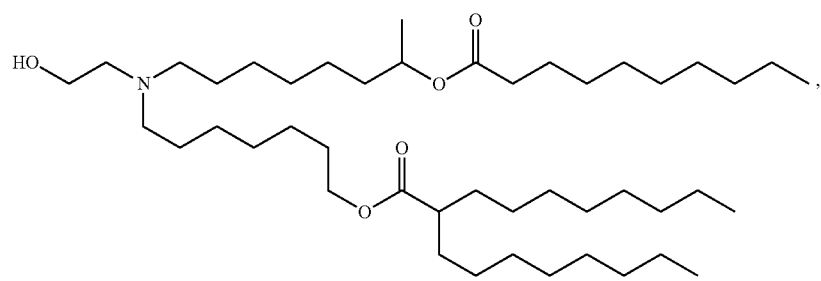
(Compound 165)
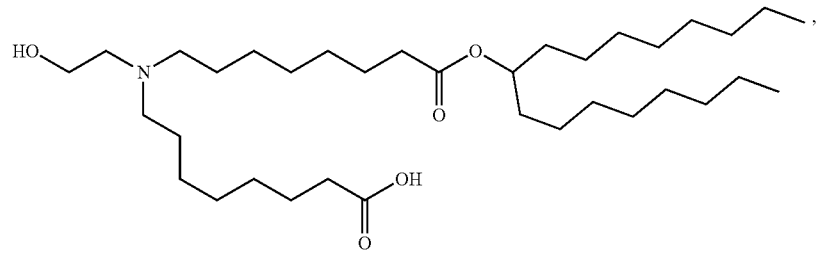
(Compound 166)
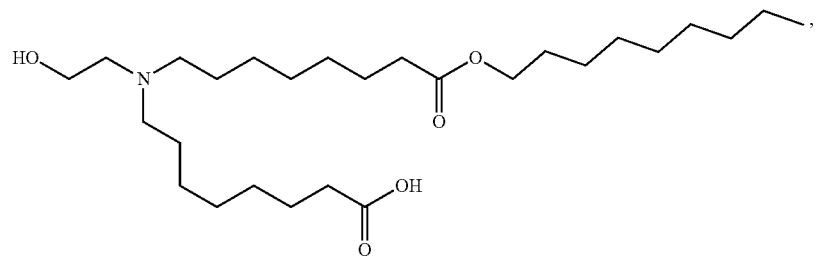
(Compound 167)

-continued
(Compound 168)
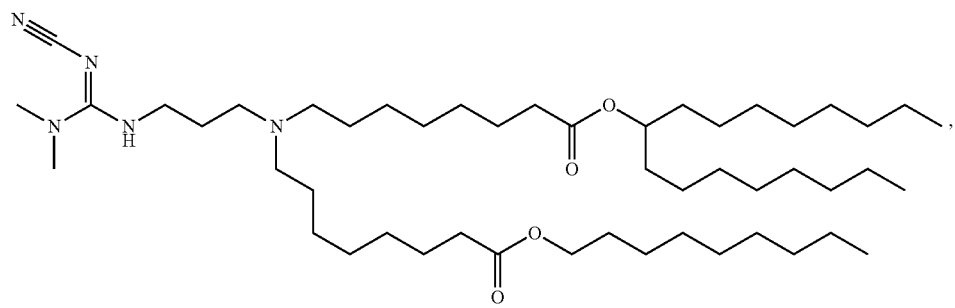
(Compound 169)
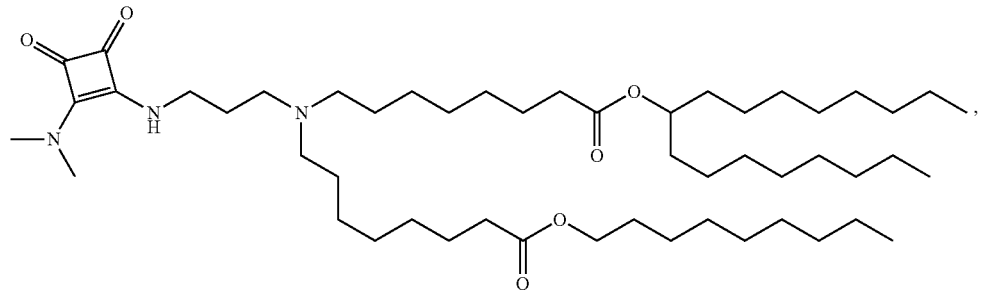
(Compound 170)
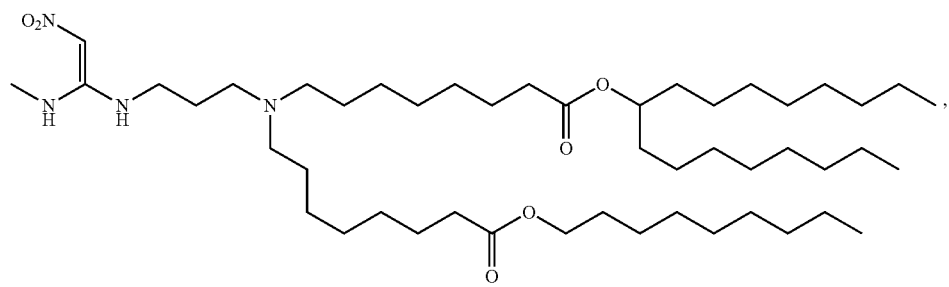
(Compound 171)
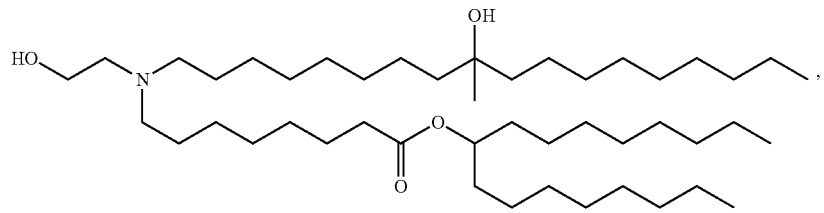
(Compound 172)
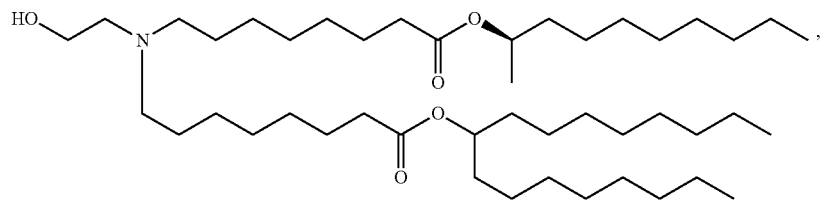
(Compound 173)
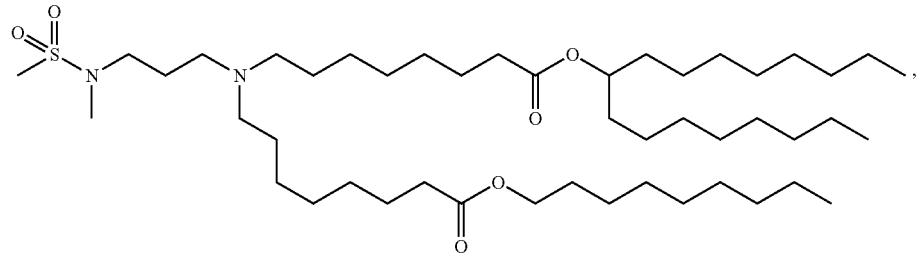

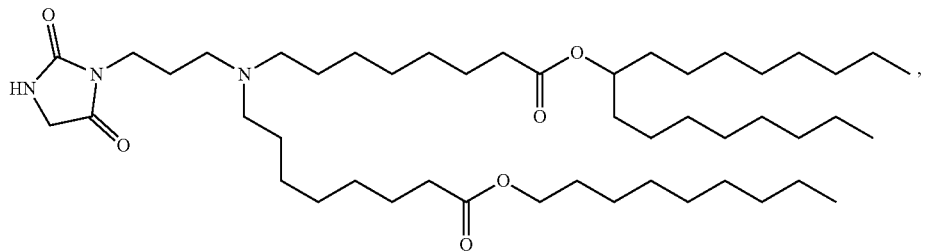
(Compound 174)
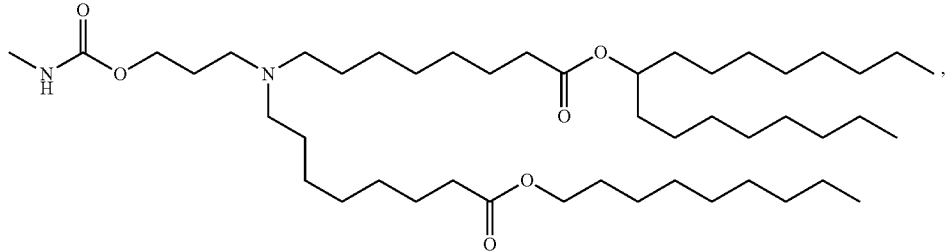
(Compound 175)
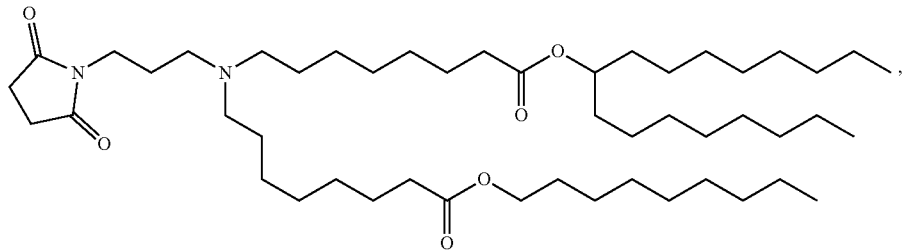
(Compound 176)
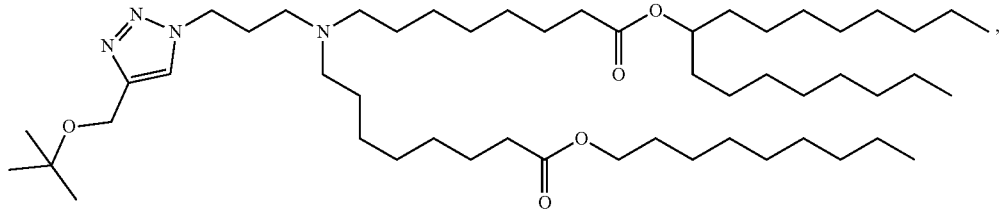
(Compound 177)
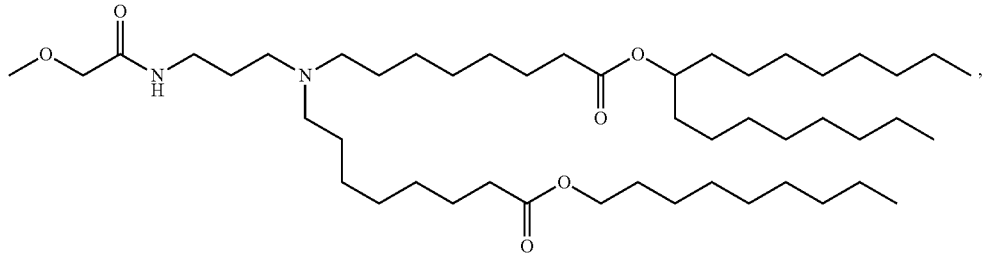
(Compound 178)
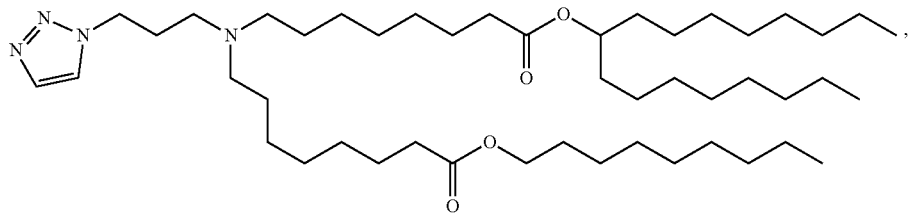
(Compound 179)

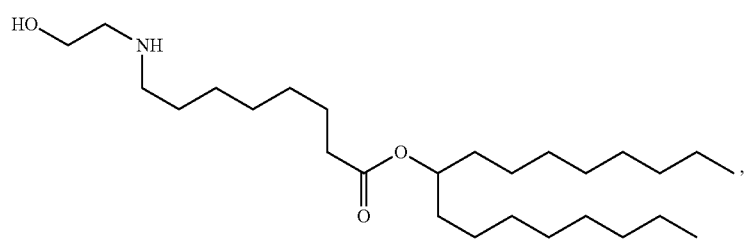
(Compound 180)
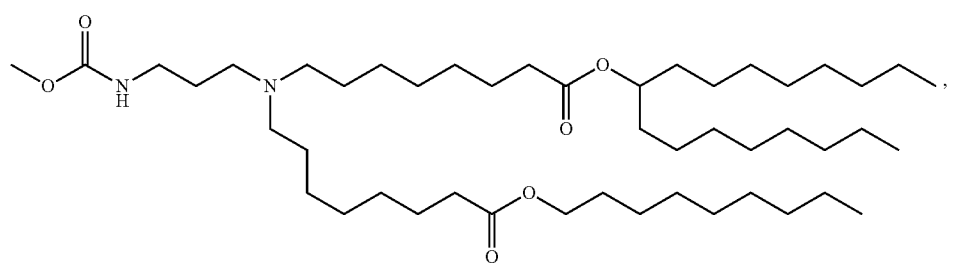
(Compound 181)
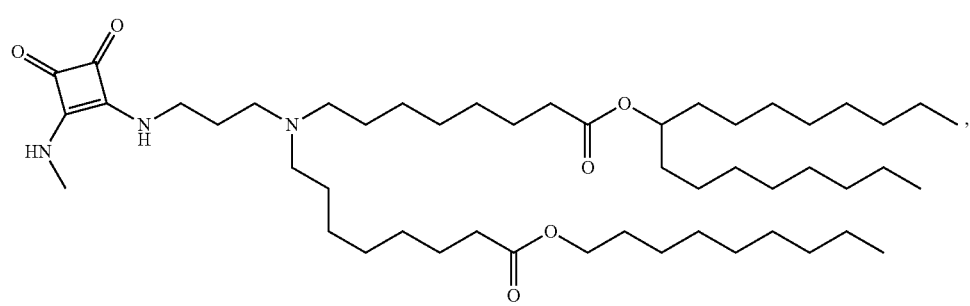
(Compound 182)
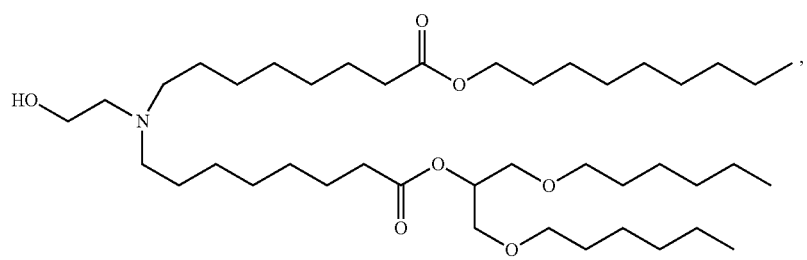
(Compound 183)
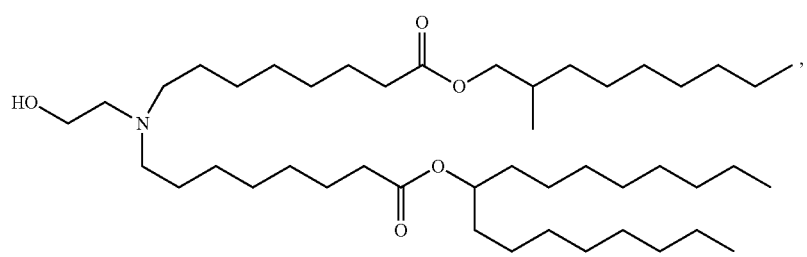
(Compound 184)
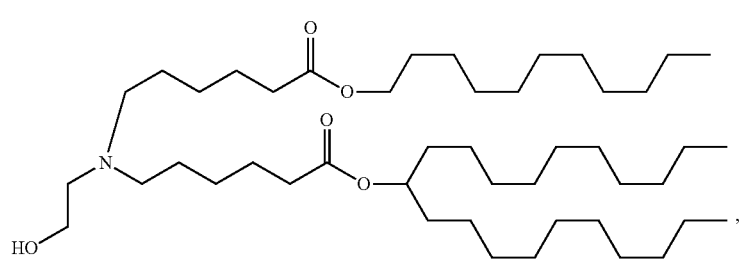
(Compound 185)

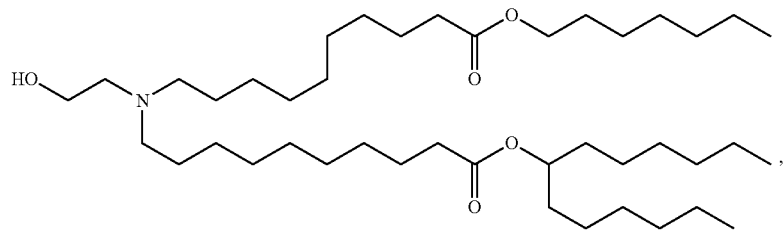
(Compound 186)
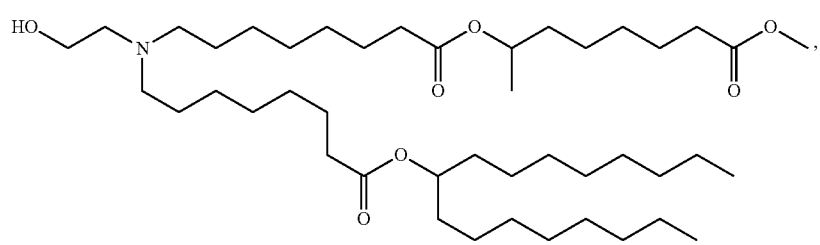
(Compound 187)
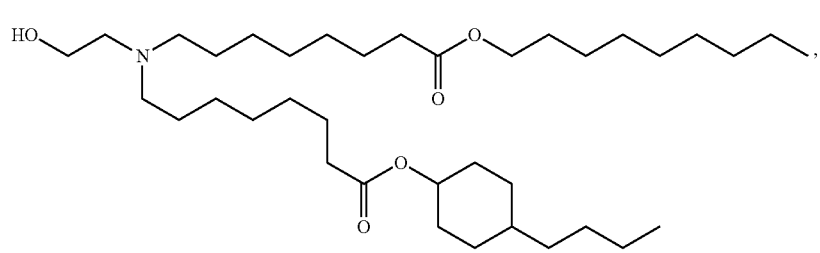
(Compound 188)
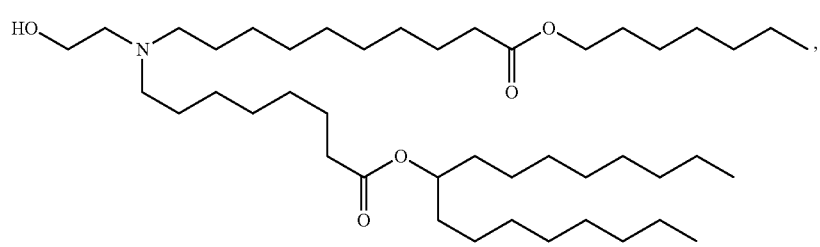
(Compound 189)
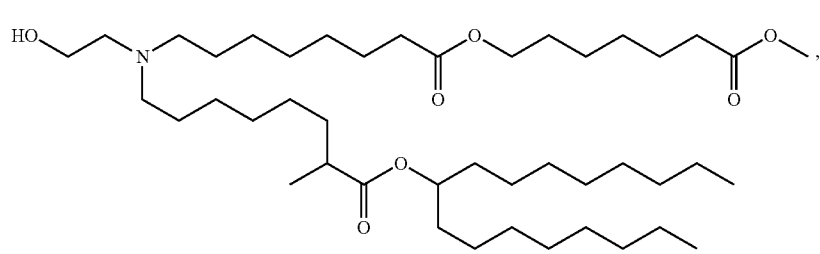
(Compound 190)
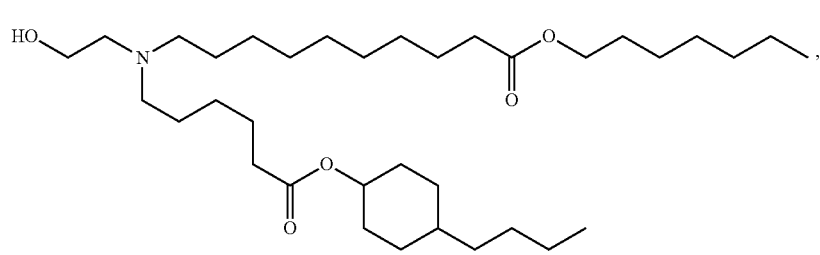
(Compound 191)

-continued
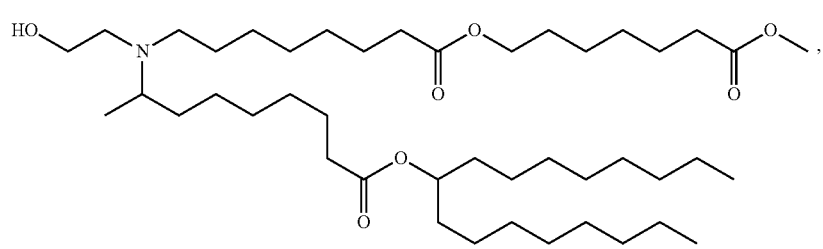
(Compound 192)
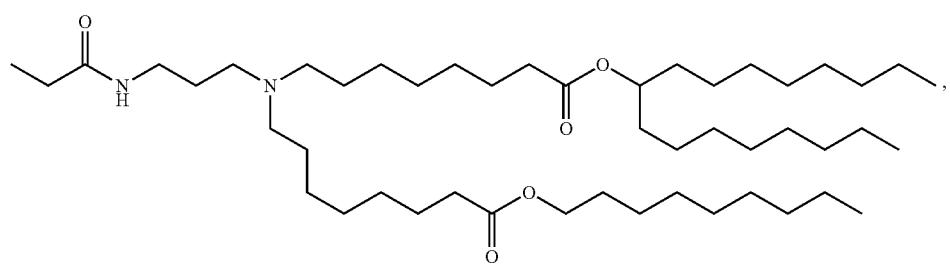
(Compound 193)
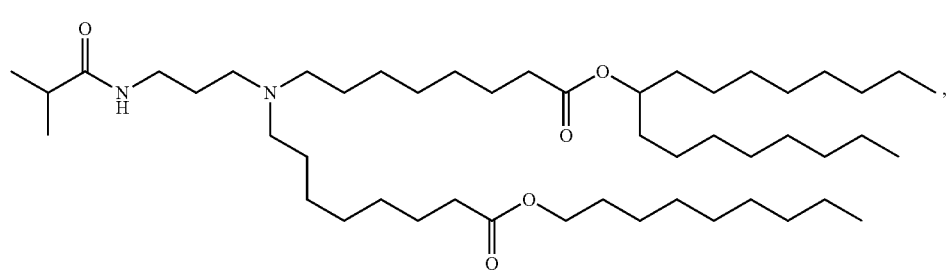
(Compound 194)
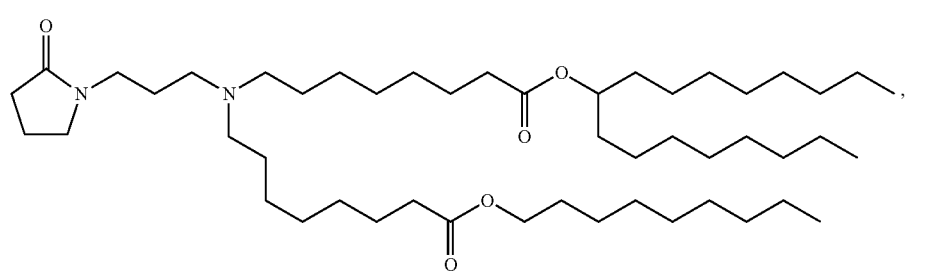
(Compound 195)
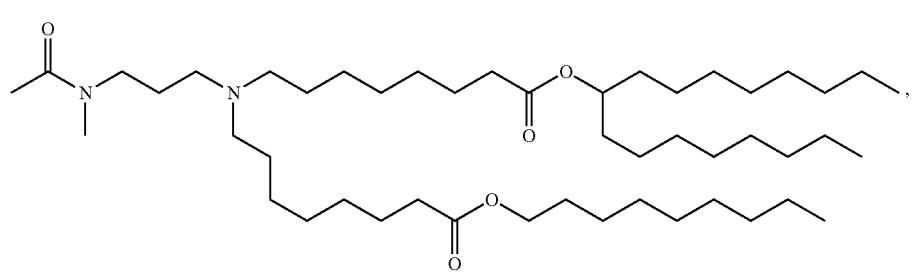
(Compound 196)
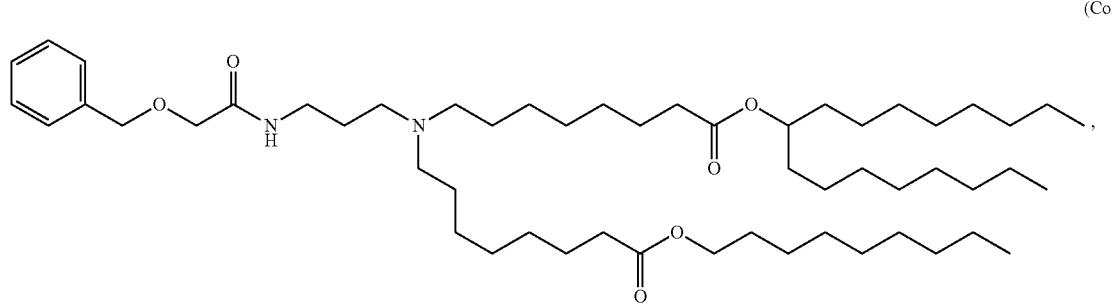
(Compound 197)

(Compound 198)
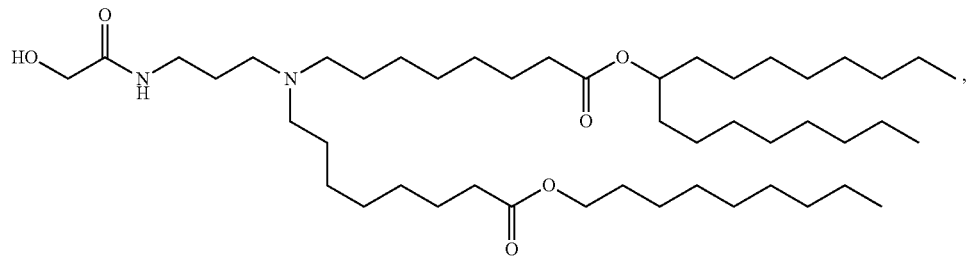
(Compound 199)
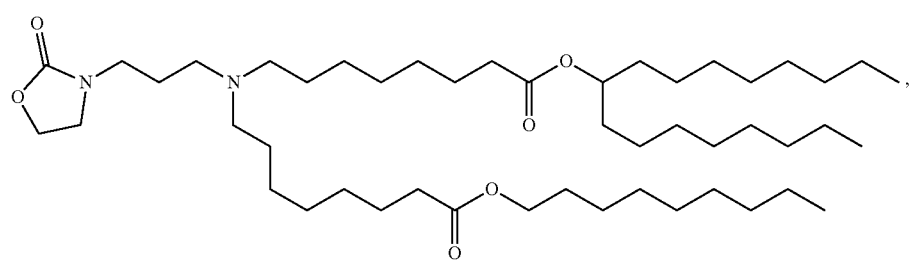
(Compound 200)
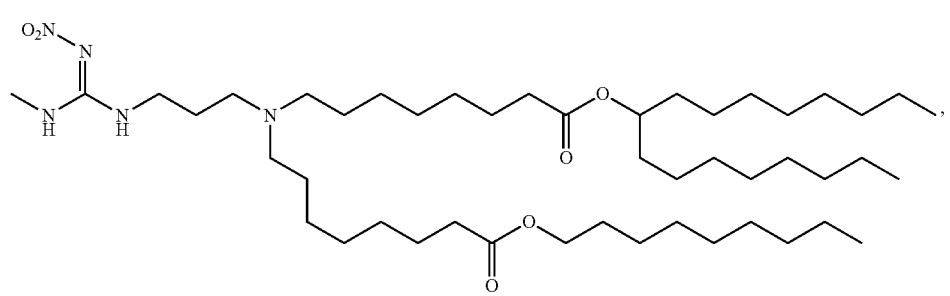
(Compound 201)
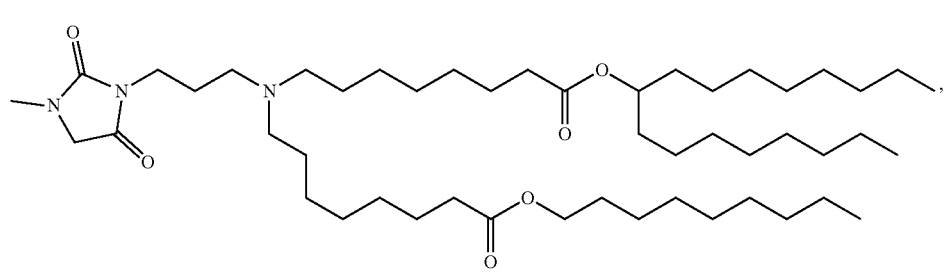
(Compound 202)
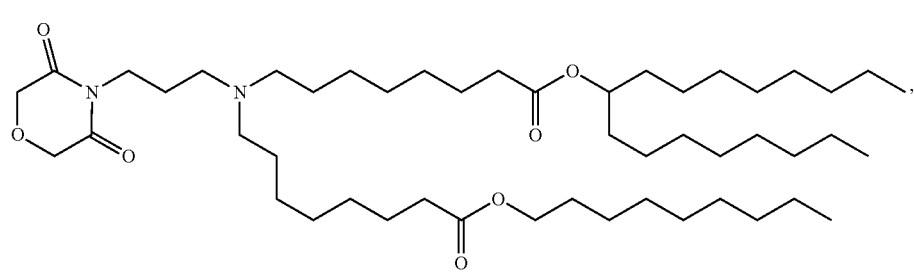
(Compound 203)
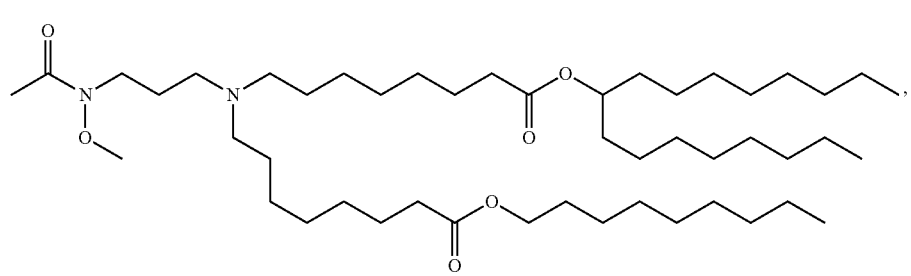

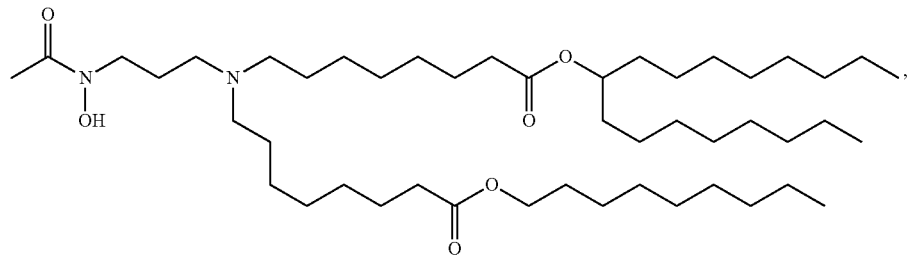
(Compound 204)
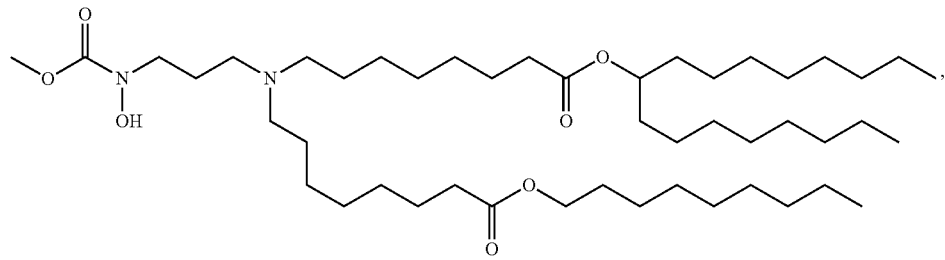
(Compound 205)
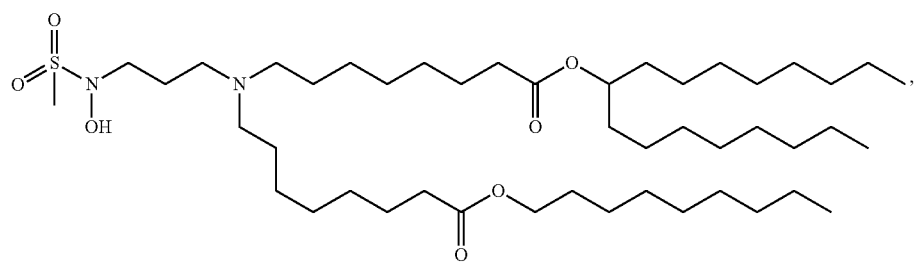
(Compound 206)
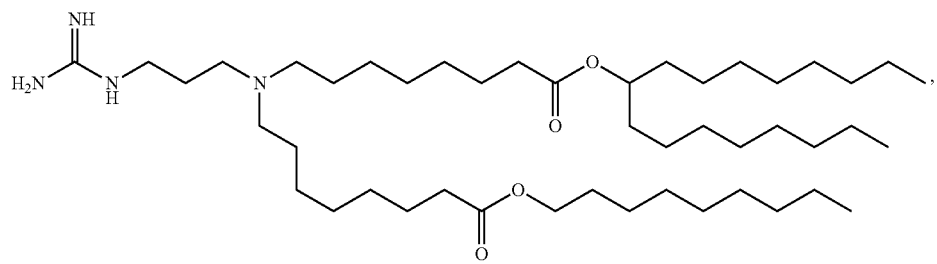
(Compound 207)
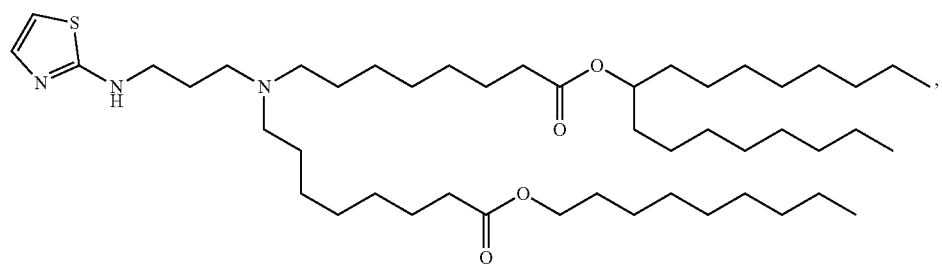
(Compound 208)
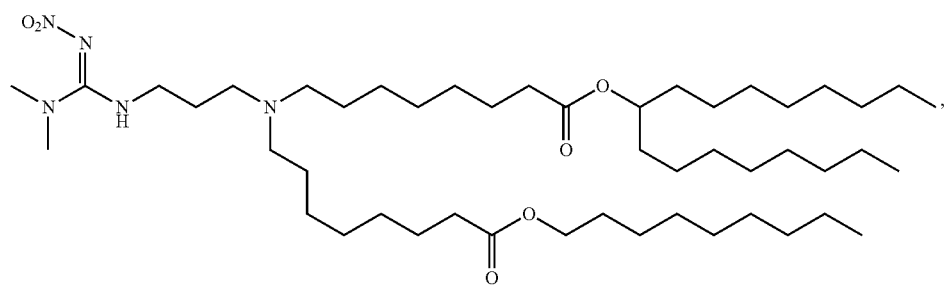
(Compound 209)

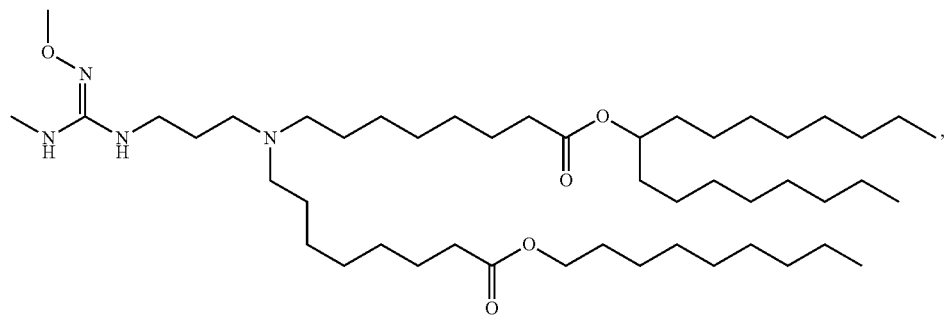
(Compound 210)
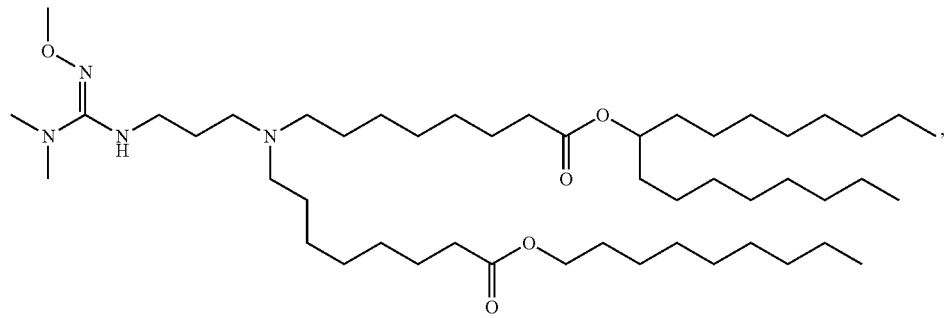
(Compound 211)
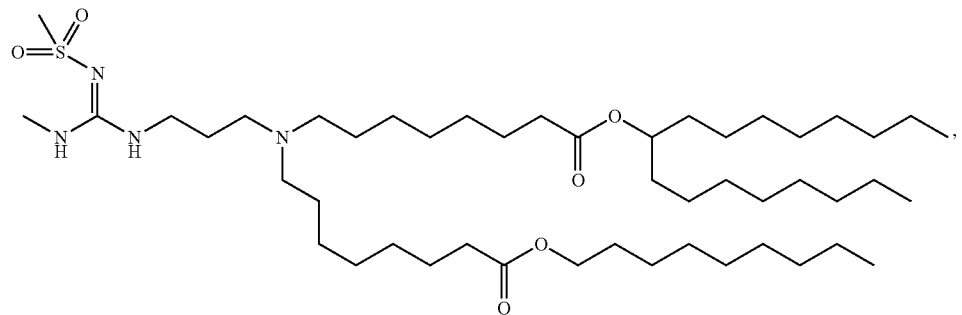
(Compound 212)
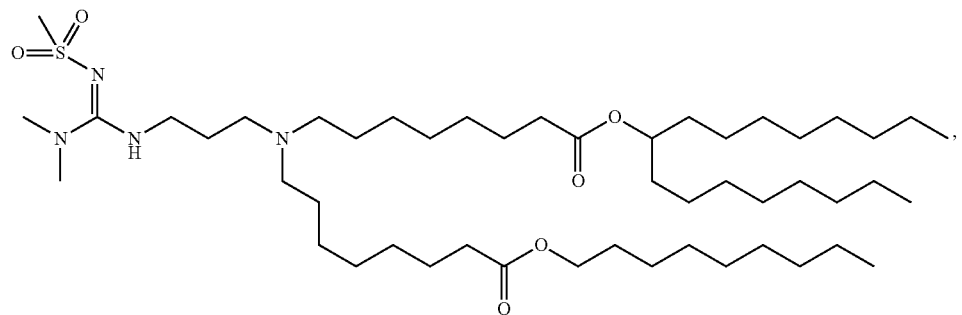
(Compound 213)
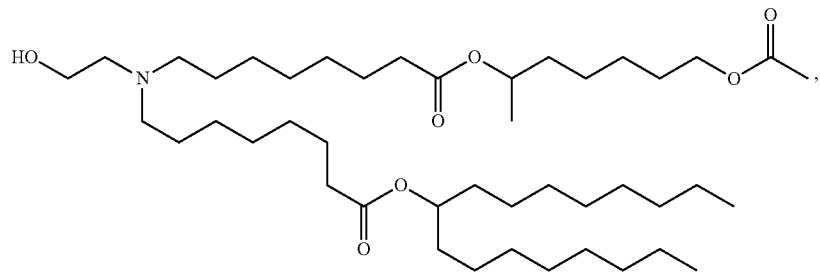
(Compound 214)

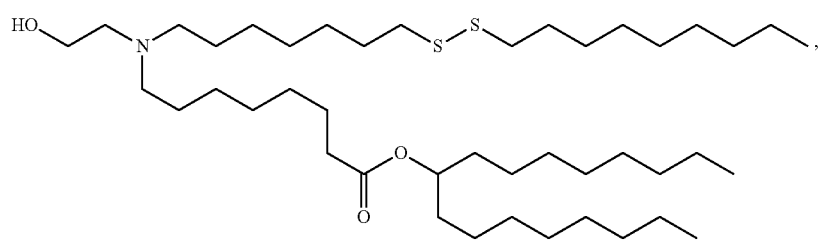
(Compound 215)
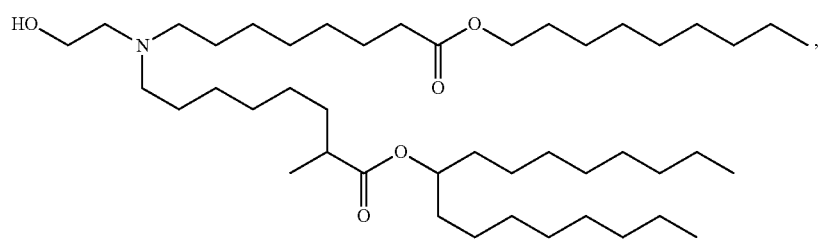
(Compound 216)
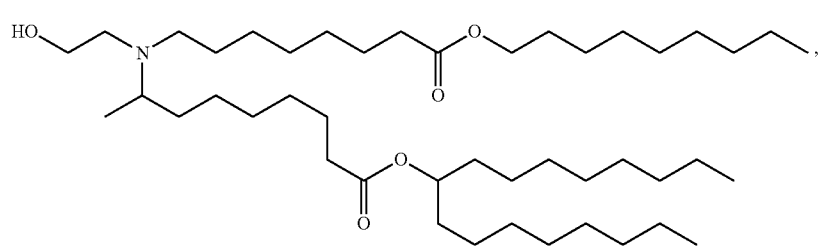
(Compound 217)
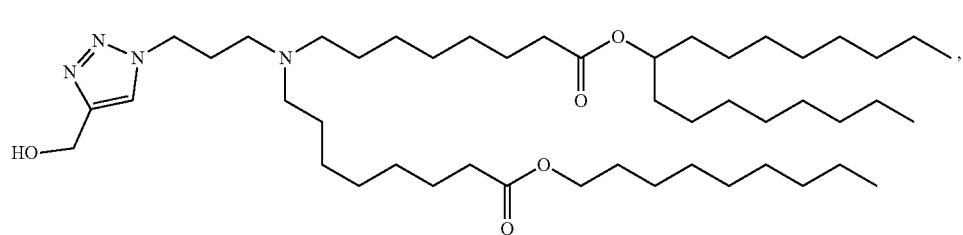
(Compound 218)
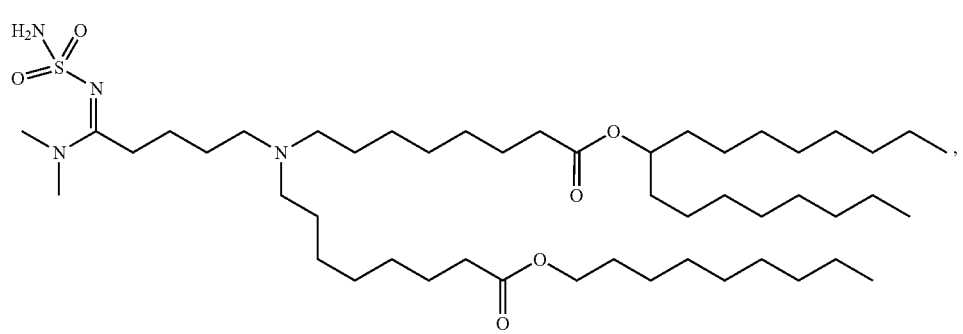
(Compound 219)
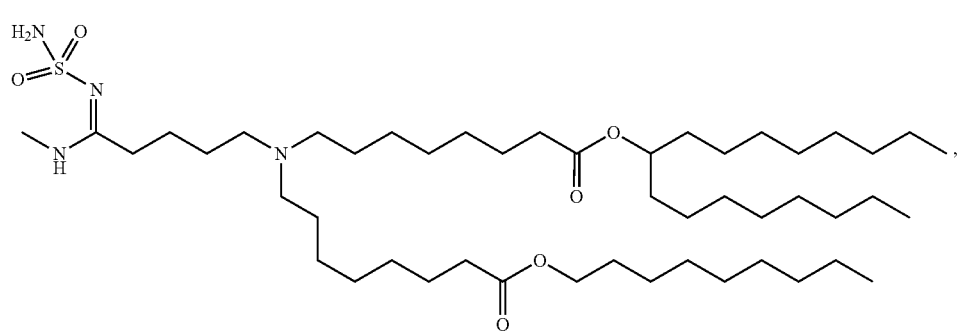
(Compound 220)

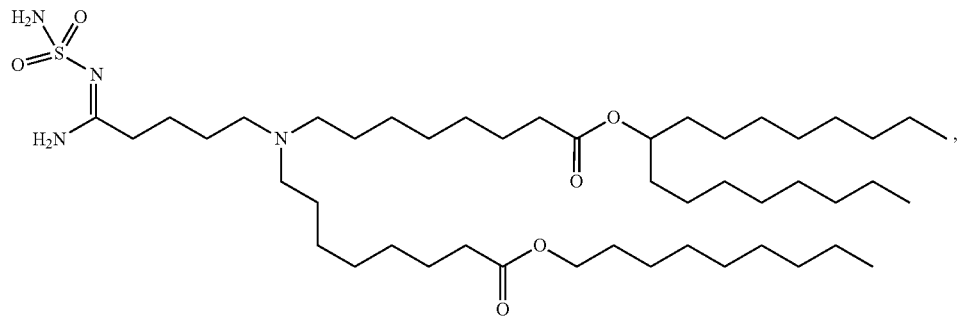
(Compound 221)
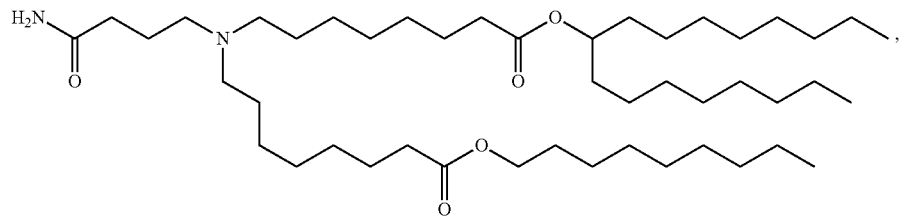
(Compound 222)
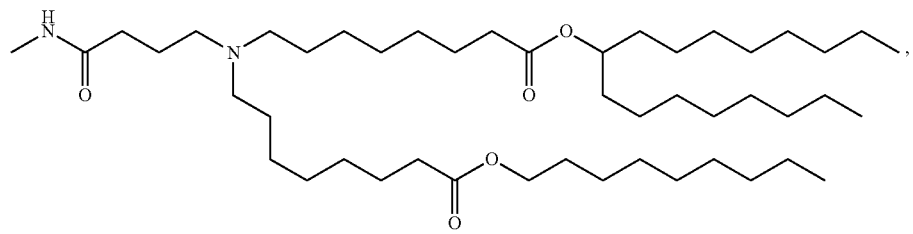
(Compound 223)
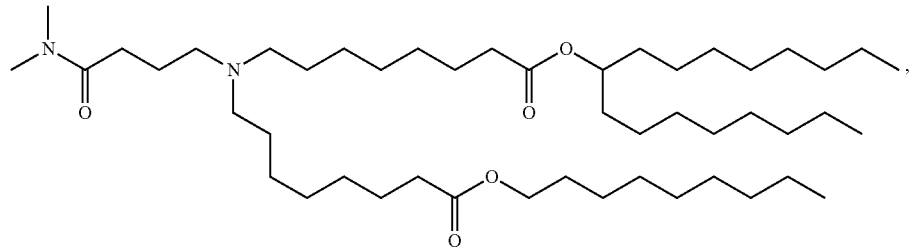
(Compound 224)
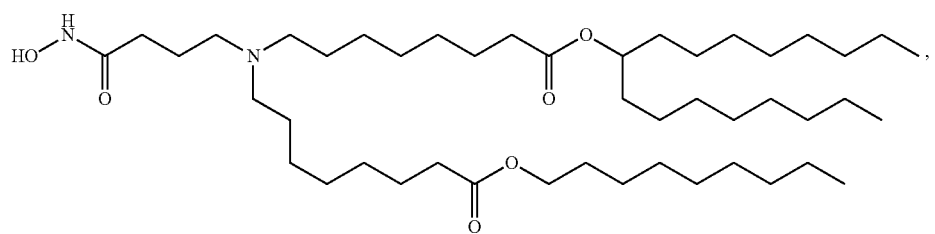
(Compound 225)
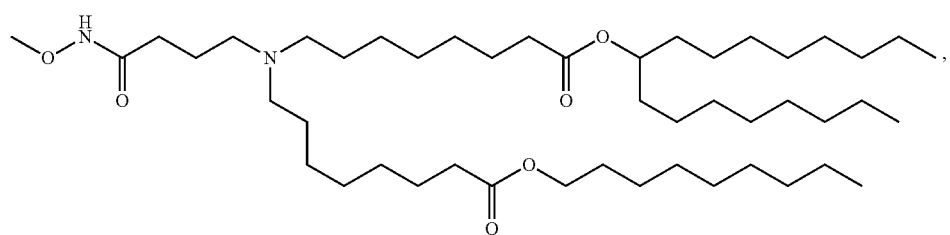
(Compound 226)

(Compound 227)

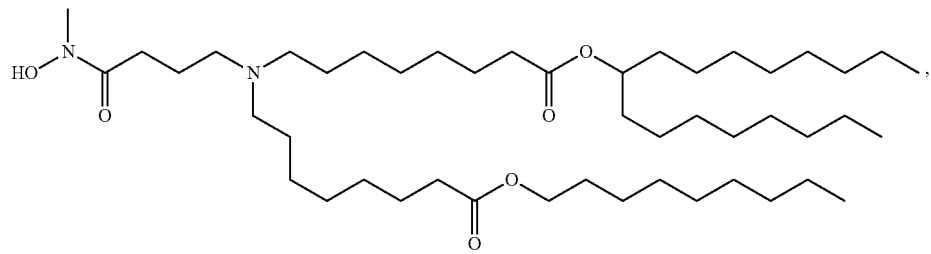

(Compound 228)

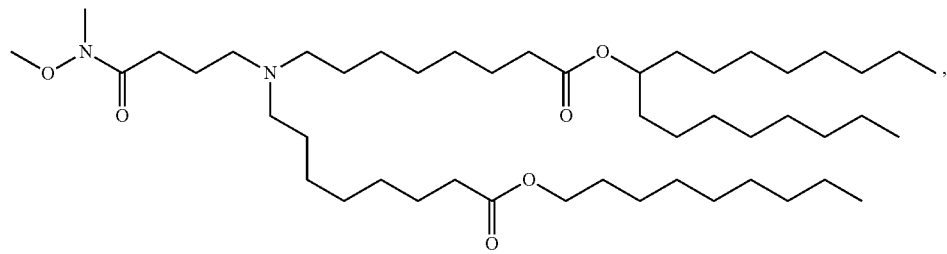

(Compound 229)

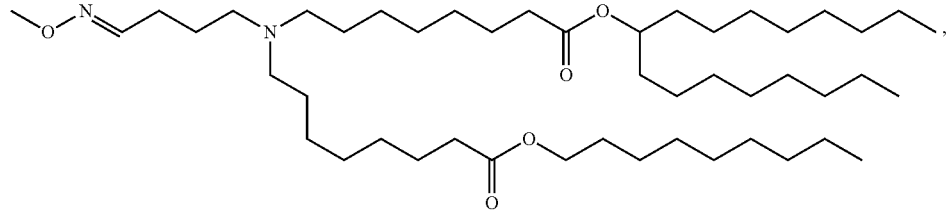

(Compound 230)

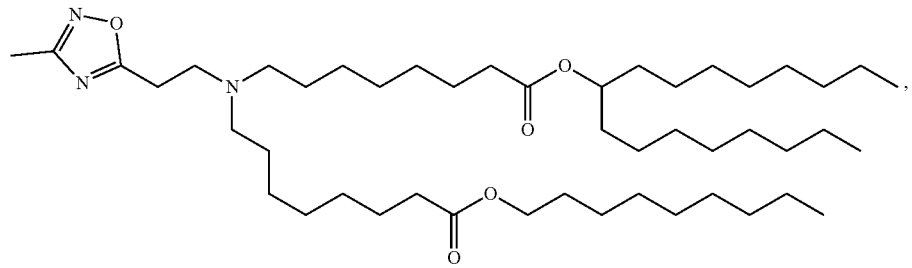

(Compound 231)

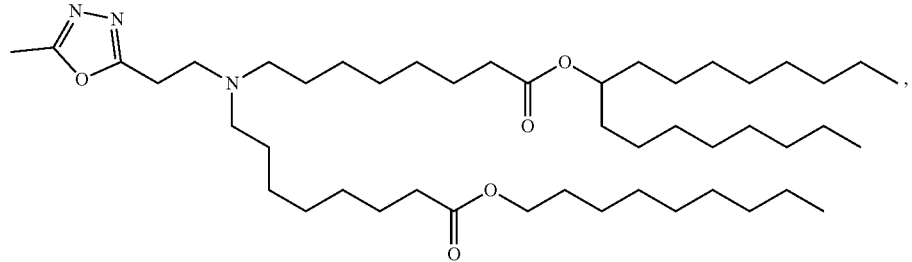

(Compound 232)

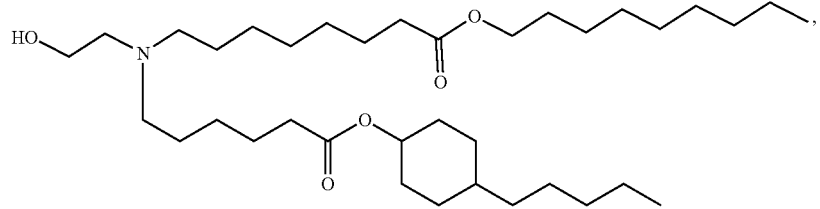

and salts or stereoisomers thereof.

In other embodiments, the compound of Formula (I) is selected from the group consisting of Compound 1-Compound 232, or salt or stereoisomers thereof.

In some embodiments ionizable lipids including a central piperazine moiety are provided. The lipids described herein may be advantageously used in lipid nanoparticle compositions for the delivery of therapeutic and/or prophylactic agents to mammalian cells or organs. For example, the lipids described herein have little or no immunogenicity. For example, the lipid compounds disclosed herein have a lower immunogenicity as compared to a reference lipid (e.g., MC3, KC2, or DLinDMA). For example, a formulation comprising a lipid disclosed herein and a therapeutic or prophylactic agent has an increased therapeutic index as compared to a corresponding formulation which comprises a reference lipid (e.g., MC3, KC2, or DLinDMA) and the same therapeutic or prophylactic agent.

In some embodiments, the delivery agent comprises a lipid compound having the Formula (III)

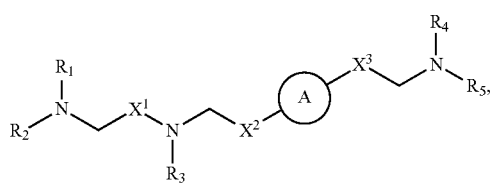
(III)

or salts or stereoisomers thereof, wherein
ring A is

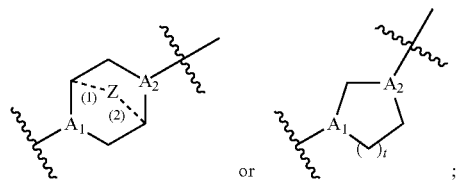
or ;

t is 1 or 2;

$A_1$ and $A_2$ are each independently selected from CH or N;

Z is $CH_2$ or absent wherein when Z is $CH_2$, the dashed lines (1) and (2) each represent a single bond; and when Z is absent, the dashed lines (1) and (2) are both absent;

$R_1$, $R_2$, $R_3$, $R_4$, and $R_5$ are independently selected from the group consisting of $C_{5-20}$ alkyl, $C_{5-20}$ alkenyl, —R"MR', —R*YR", —YR", and —R*OR";

each M is independently selected from the group consisting of C(O)O, OC(O), OC(O)O, C(O)N(R'), N(R')C(O), C(O), C(S), C(S)S, SC(S), CH(OH), P(O)(OR')O, S(O)$_2$, an aryl group, and a heteroaryl group;

$X^1$, $X^2$, and $X^3$ are independently selected from the group consisting of a bond, $CH_2$, —$(CH_2)_2$-, CHR, CHY, C(O), C(O)O, OC(O), —C(O)—$CH_2$—, —$CH_2$—C(O)—, C(O)O—$CH_2$, OC(O)—$CH_2$, $CH_2$—C(O)O, $CH_2$—OC(O), CH(OH), C(S), and CH(SH);

each Y is independently a $C_{3-6}$ carbocycle;

each R* is independently selected from the group consisting of $C_{1-12}$ alkyl and $C_{2-12}$ alkenyl;

each R is independently selected from the group consisting of $C_{1-3}$ alkyl and a $C_{3-6}$ carbocycle;

each R' is independently selected from the group consisting of $C_{1-12}$ alkyl, $C_{2-12}$ alkenyl, and H; and each R" is independently selected from the group consisting of $C_{3-12}$ alkyl and $C_{3-12}$ alkenyl, wherein when ring A is

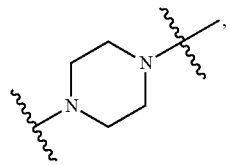

then
i) at least one of $X^1$, $X^2$, and $X^3$ is not —$CH_2$—; and/or
ii) at least one of $R_1$, $R_2$, $R_3$, $R_4$, and $R_5$ is —R"MR'.

In some embodiments, the compound is of any of formulae (IIIa1)-(IIIa6):

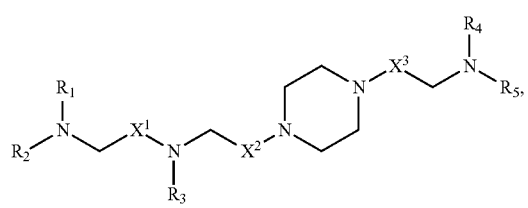
(IIIa1)

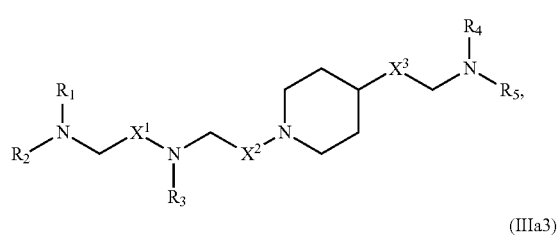
(IIIa2)

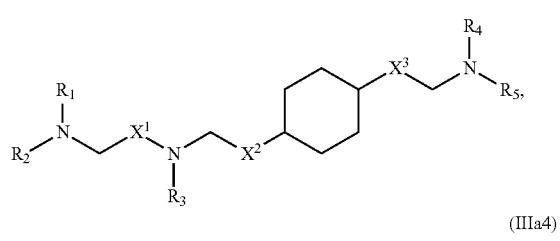
(IIIa3)

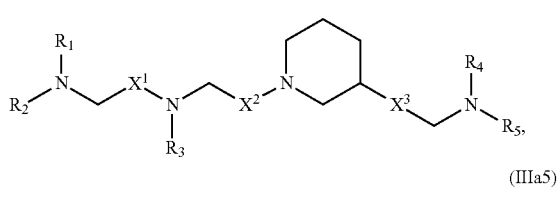
(IIIa4)

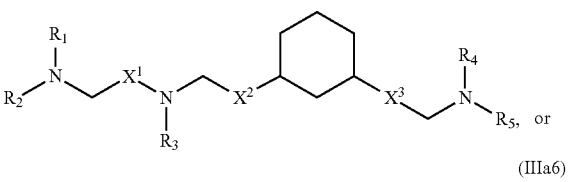
(IIIa5)

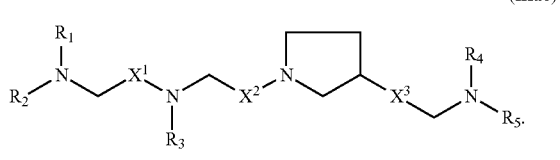
(IIIa6)

The compounds of Formula (III) or any of (IIIa1)-(IIIa6) include one or more of the following features when applicable.

In some embodiments, ring A is

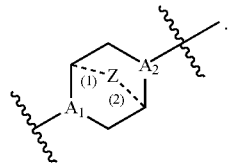

In some embodiments, ring A is or

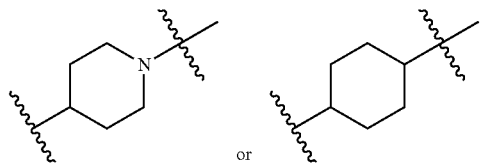

In some embodiments, ring A is

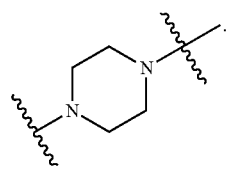 [SMILES: *N1CCN(*)CC1]

In some embodiments, ring A is

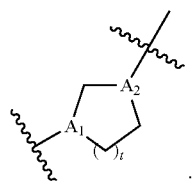

In some embodiments, ring A is

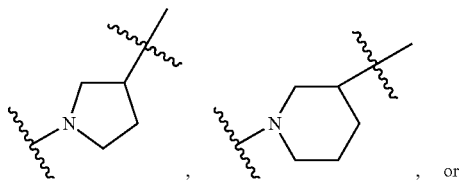

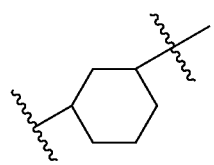

In some embodiments, ring A is

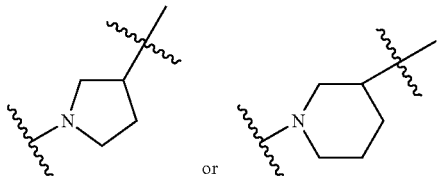 [SMILES: *C1CCN(*)C1 ; *C1CCCN(*)C1]

wherein ring, in which the N atom is connected with $X^2$.

In some embodiments, Z is $CH_2$.

In some embodiments, Z is absent.

In some embodiments, at least one of $A_1$ and $A_2$ is N.

In some embodiments, each of $A_1$ and $A_2$ is N.

In some embodiments, each of $A_1$ and $A_2$ is CH.

In some embodiments, $A_1$ is N and $A_2$ is CH.

In some embodiments, $A_1$ is CH and $A_2$ is N.

In some embodiments, at least one of $X^1$, $X^2$, and $X^3$ is not —$CH_2$—. For example, in certain embodiments, $X^1$ is not —$CH_2$—. In some embodiments, at least one of $X^1$, $X^2$, and $X^3$ is —C(O)—.

In some embodiments, $X^2$ is —C(O)—, —C(O)O, OC(O), —C(O)—$CH_2$—, —$CH_2$—C(O)—, C(O)O—$CH_2$, OC(O)—$CH_2$, $CH_2$—C(O)O, or $CH_2$—OC(O).

In some embodiments, $X^3$ is —C(O)—, —C(O)O—, —OC(O)—, —C(O)—$CH_2$—, —$CH_2$—C(O)—, —C(O)O—$CH_2$, OC(O)—$CH_2$, $CH_2$—C(O)O, or $CH_2$—OC(O). In other embodiments, $X^3$ is —$CH_2$—.

In some embodiments, $X^3$ is a bond or —$(CH_2)_2$—.

In some embodiments, $R_1$ and $R_2$ are the same. In certain embodiments, $R_1$, $R_2$, and $R_3$ are the same. In some embodiments, $R_4$ and $R_5$ are the same. In certain embodiments, $R_1$, $R_2$, $R_3$, $R_4$, and $R_5$ are the same.

In some embodiments, at least one of $R_1$, $R_2$, $R_3$, $R_4$, and $R_5$ is —R"MR'. In some embodiments, at most one of $R_1$, $R_2$, $R_3$, $R_4$, and $R_5$ is —R"MR'. For example, at least one of $R_1$, $R_2$, and $R_3$ may be —R"MR', and/or at least one of $R_4$ and $R_5$ is —R"MR'. In certain embodiments, at least one M is —C(O)O—. In some embodiments, each M is —C(O)O—. In some embodiments, at least one M is —OC(O)—. In some embodiments, each M is —OC(O)—. In some embodiments, at least one M is —OC(O)O—. In some embodiments, each M is —OC(O)O—. In some embodiments, at least one R" is $C_3$ alkyl. In certain embodiments, each R" is $C_3$ alkyl. In some embodiments, at least one R" is $C_5$ alkyl. In certain embodiments, each R" is $C_5$ alkyl. In some embodiments, at least one R" is $C_6$ alkyl. In certain embodiments, each R" is $C_6$ alkyl. In some embodiments, at least one R" is $C_7$ alkyl. In certain embodiments, each R" is $C_7$ alkyl. In some embodiments, at least one R' is $C_5$ alkyl. In certain embodiments, each R' is $C_5$ alkyl. In other embodiments, at least one R' is $C_1$ alkyl. In certain embodiments, each R' is $C_1$ alkyl. In some embodiments, at least one R' is $C_2$ alkyl. In certain embodiments, each R' is $C_2$ alkyl.

In some embodiments, at least one of $R_1$, $R_2$, $R_3$, $R_4$, and $R_5$ is $C_{12}$ alkyl. In certain embodiments, each of $R_1$, $R_2$, $R_3$, $R_4$, and $R_5$ are $C_{12}$ alkyl.

In certain embodiments, the compound is selected from the group consisting of:

(Compound 233)
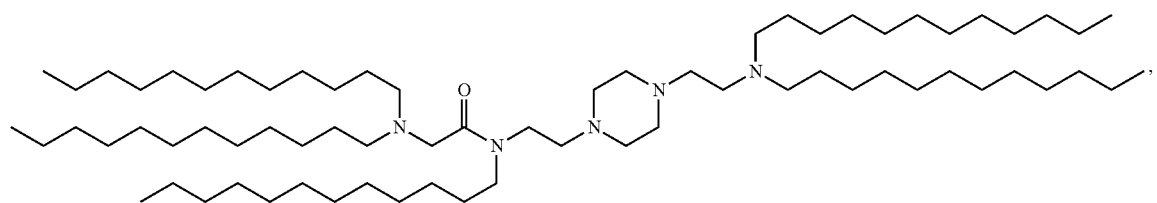
(Compound 234)
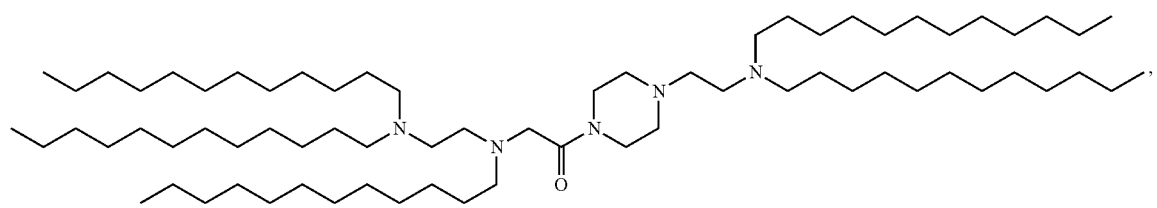
(Compound 235)
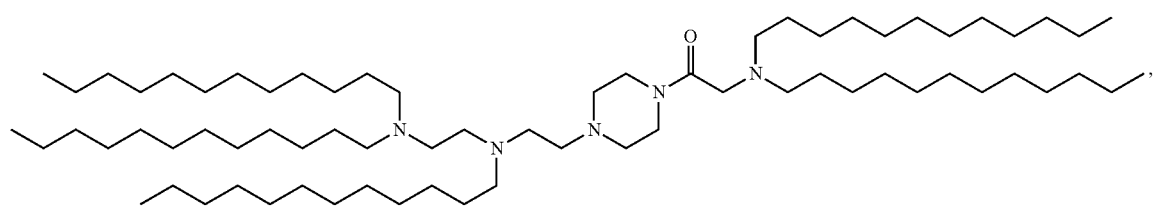
(Compound 236)
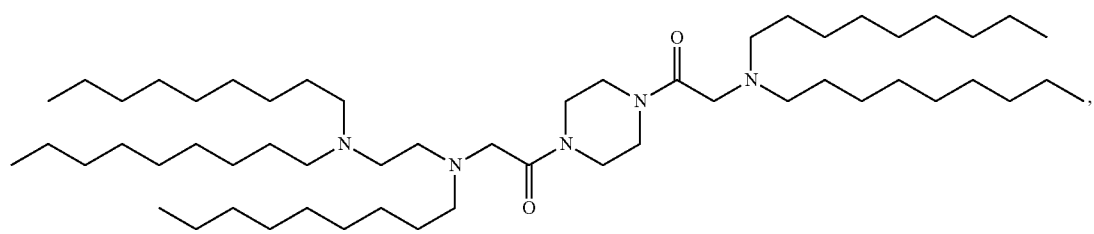
(Compound 237)
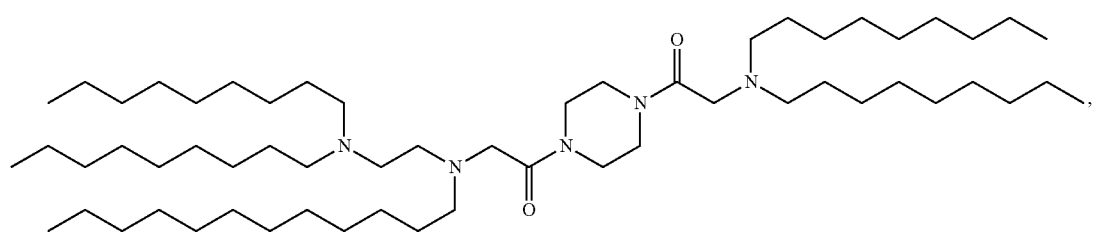
(Compound 238)
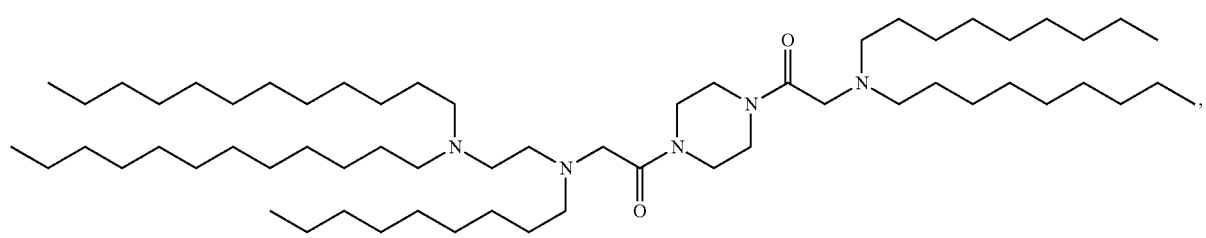

(Compound 239)
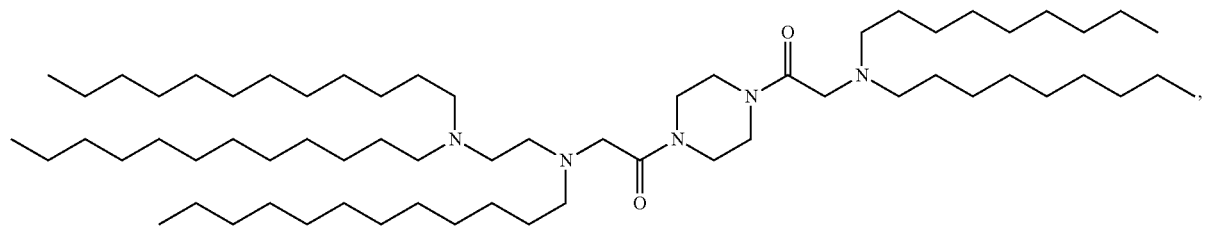
(Compound 240)
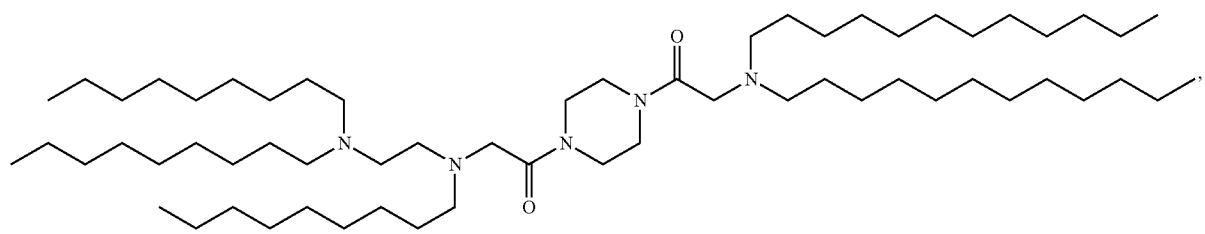
(Compound 241)
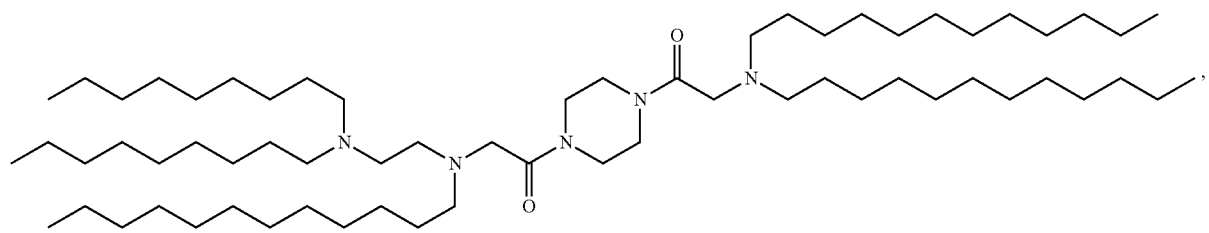
(Compound 242)
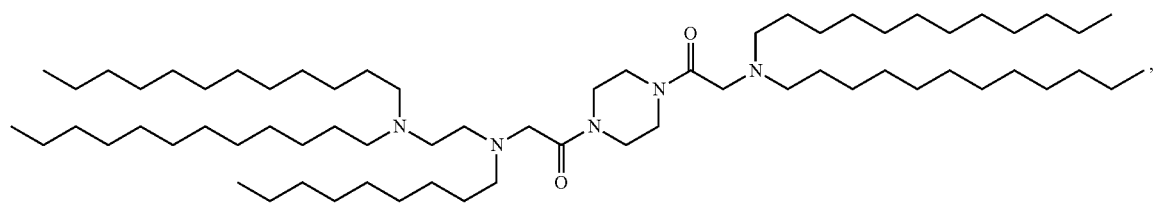
(Compound 243)
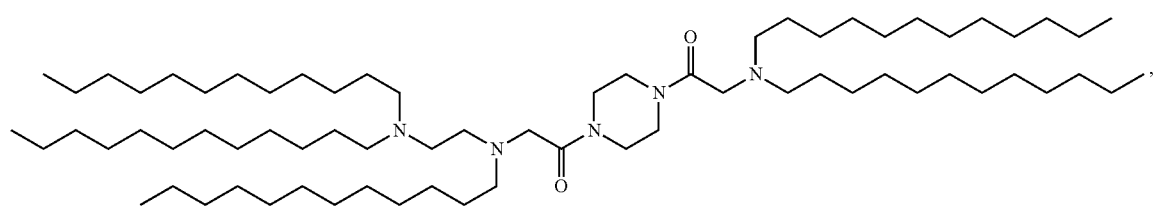
(Compound 244)
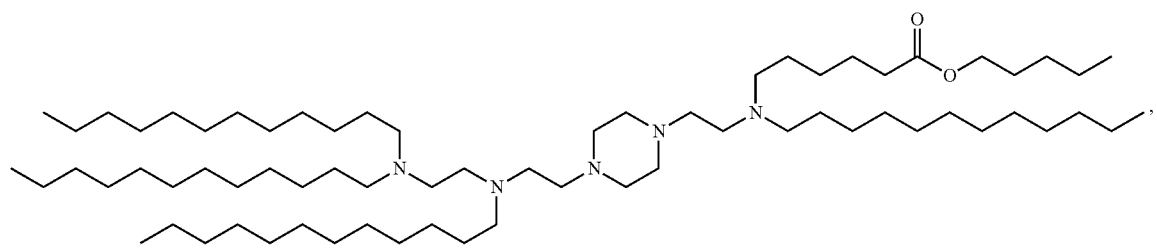

(Compound 245)
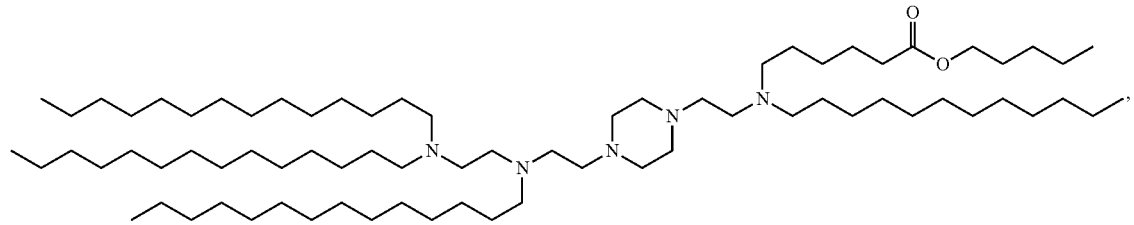
(Compound 246)
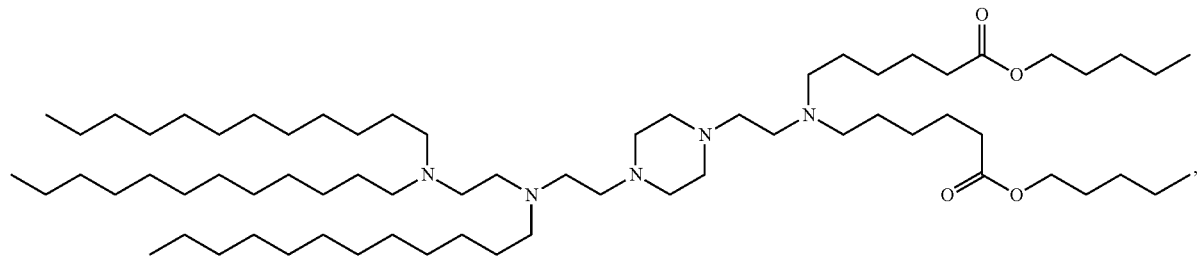
(Compound 247)
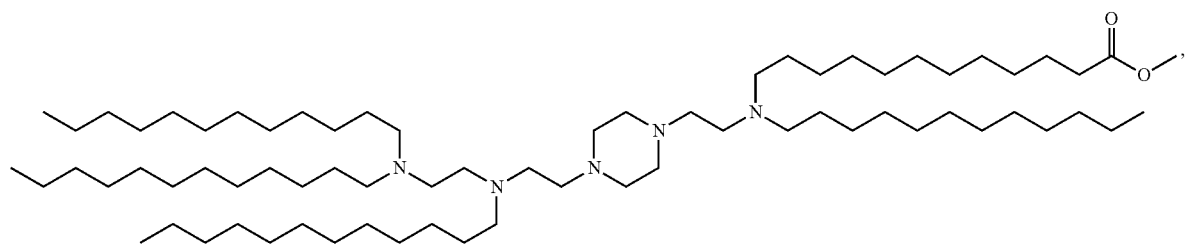
(Compound 248)
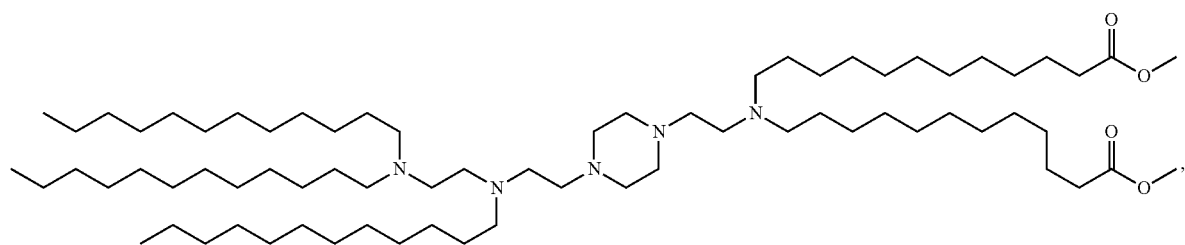
(Compound 274)
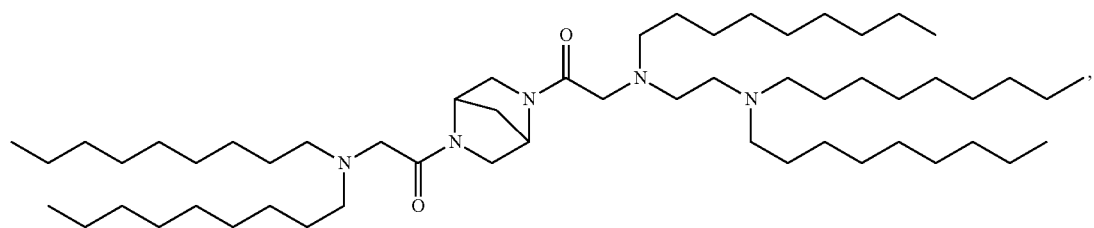
(Compound 275)
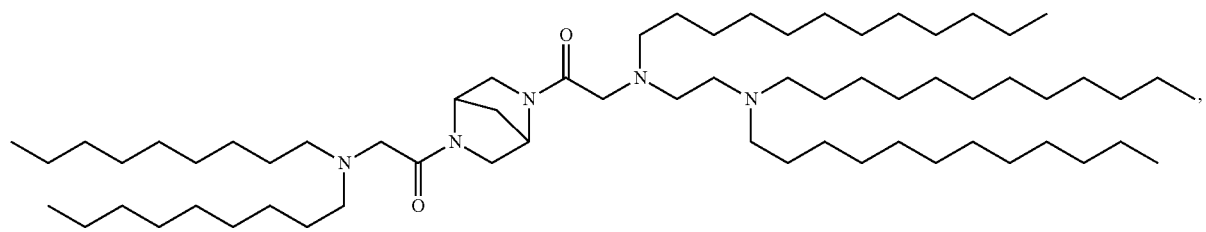

-continued
(Compound 276)
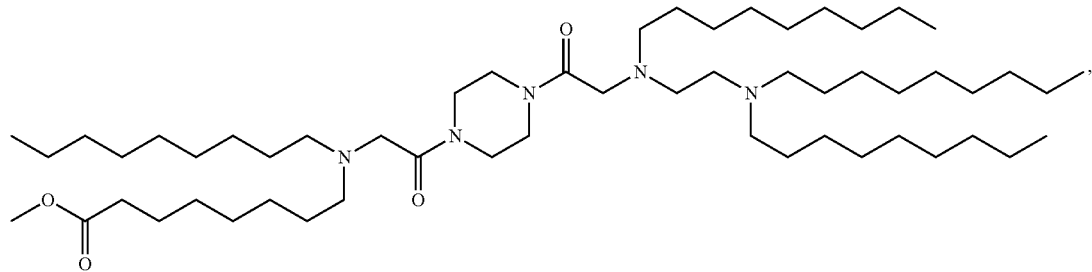
(Compound 277)
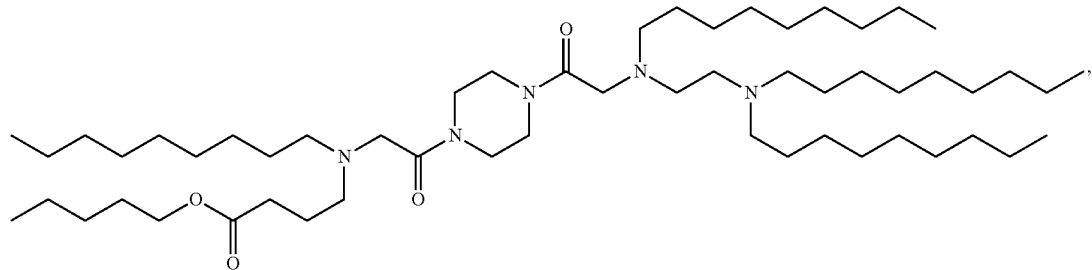
(Compound 278)
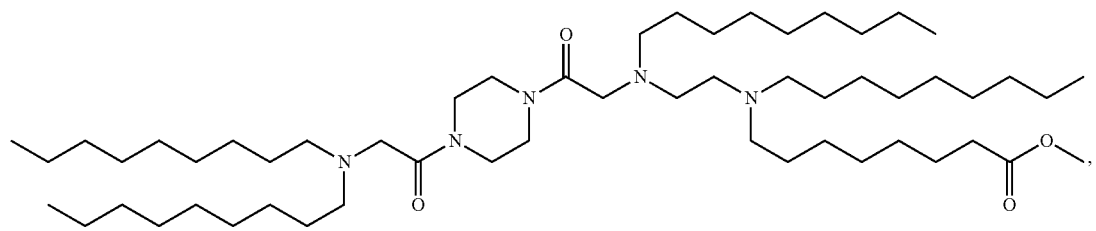
(Compound 279)
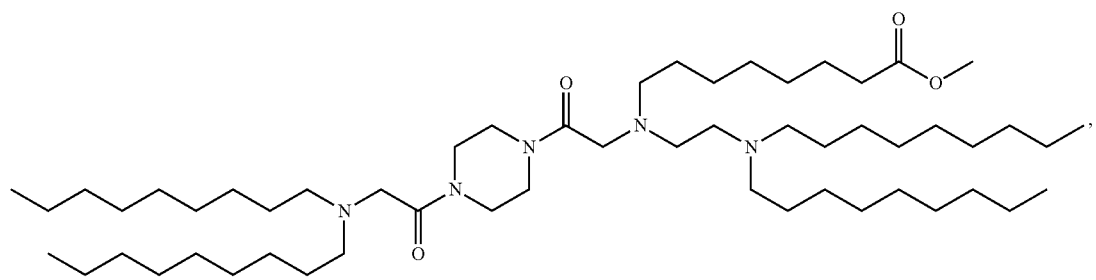
(Compound 280)
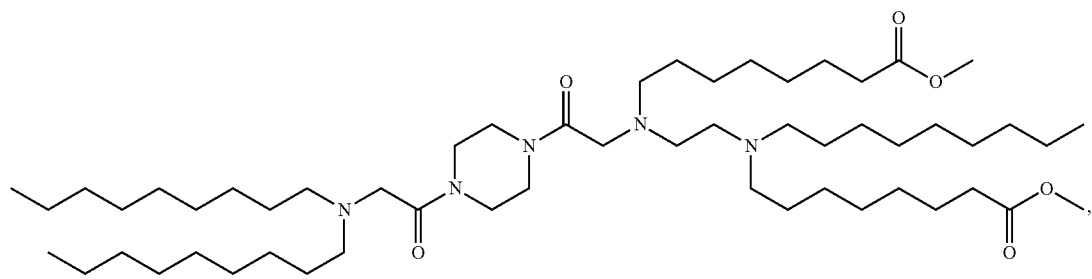

-continued
(Compound 281)
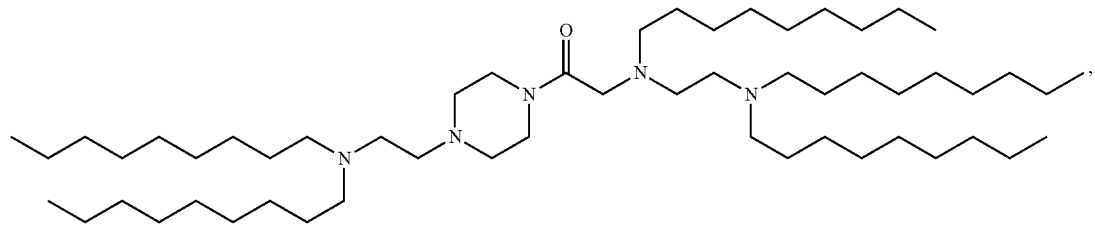
(Compound 282)
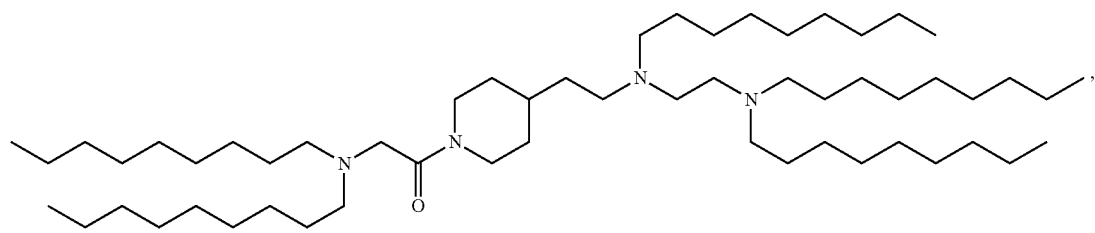
(Compound 283)
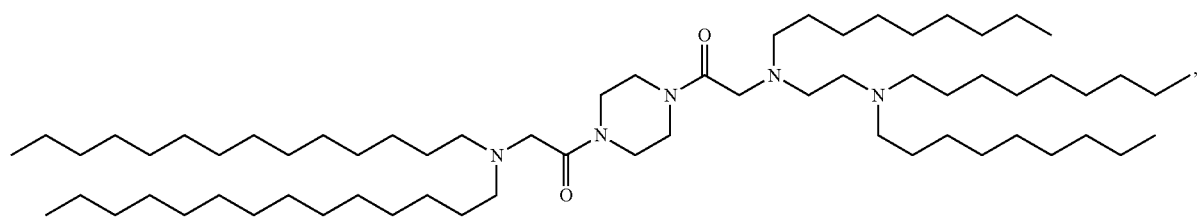
(Compound 284)
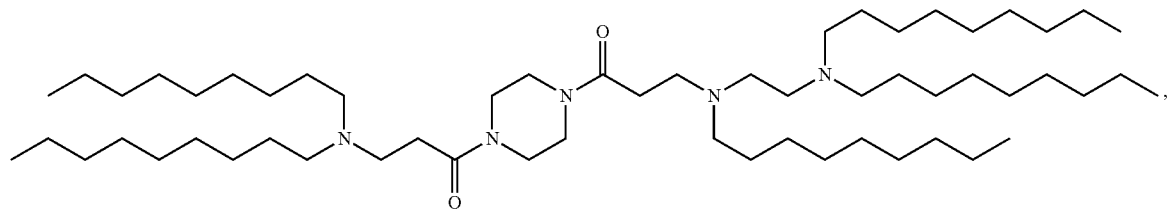
(Compound 285)
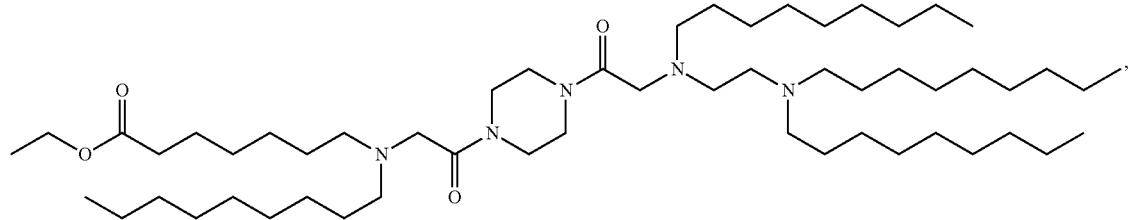
(Compound 286)
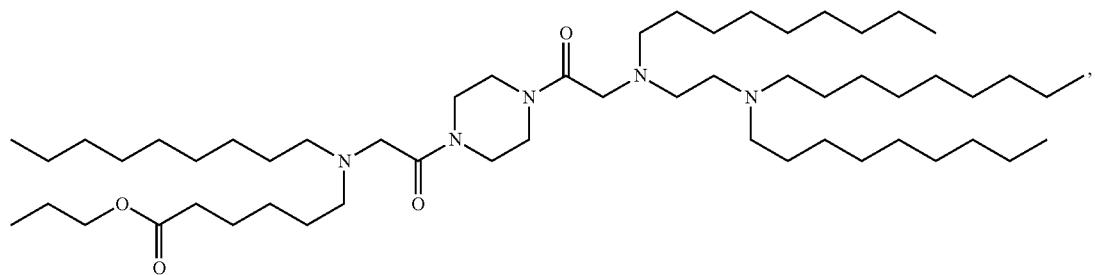

-continued
(Compound 287)
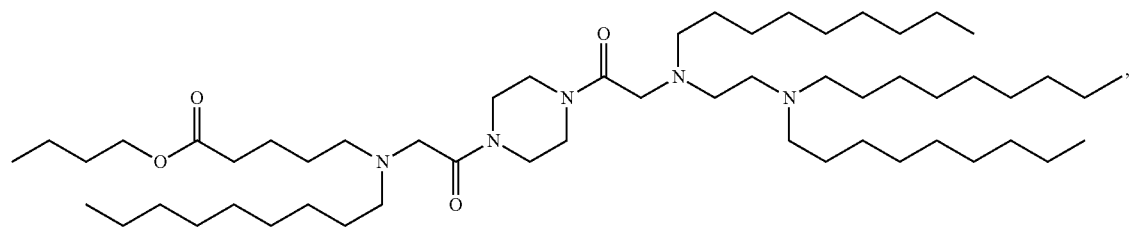
(Compound 288)
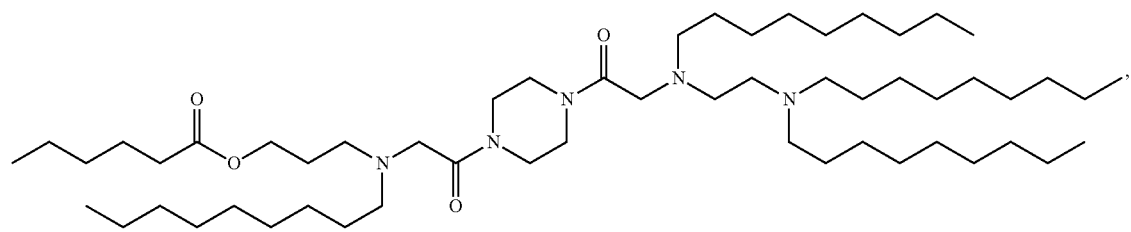
(Compound 289)
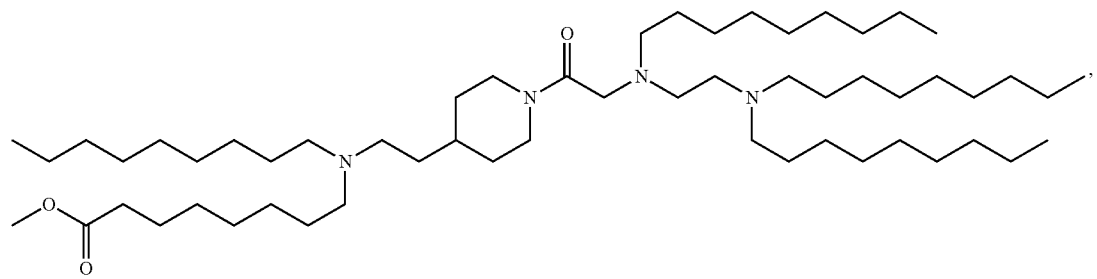
(Compound 290)
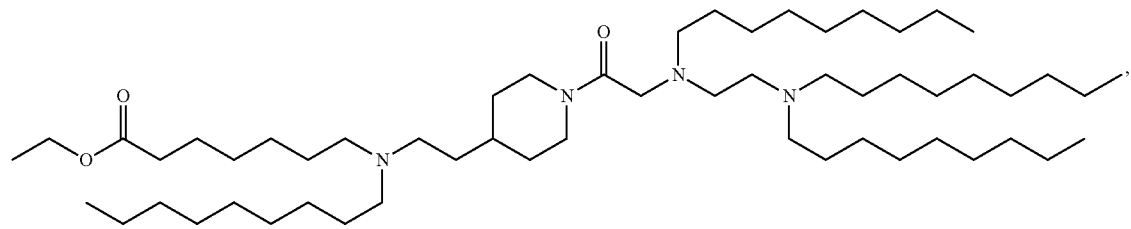
(Compound 291)
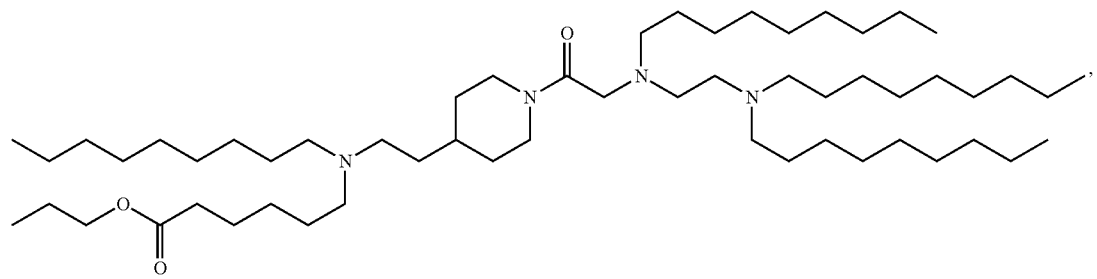
(Compound 292)
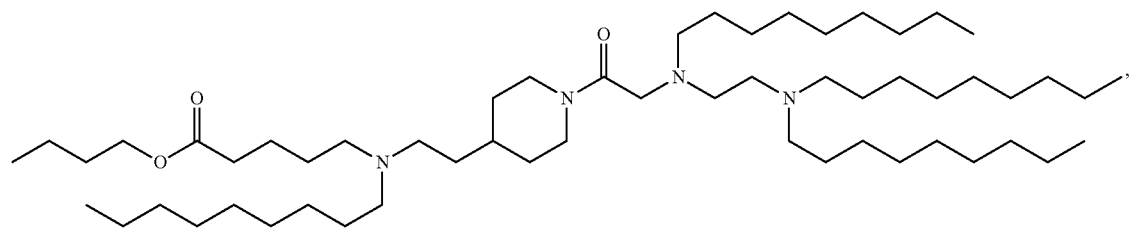

(Compound 293)
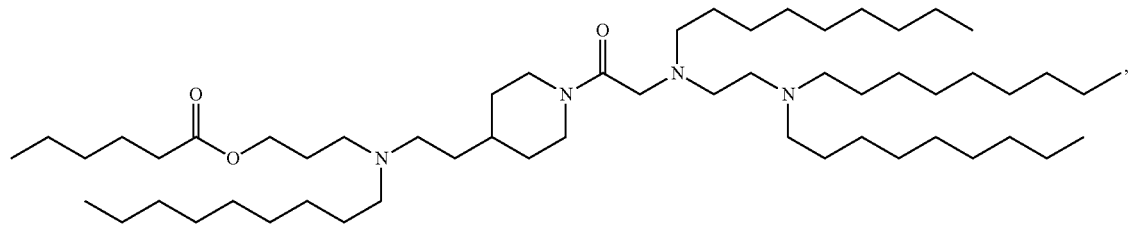
(Compound 294)
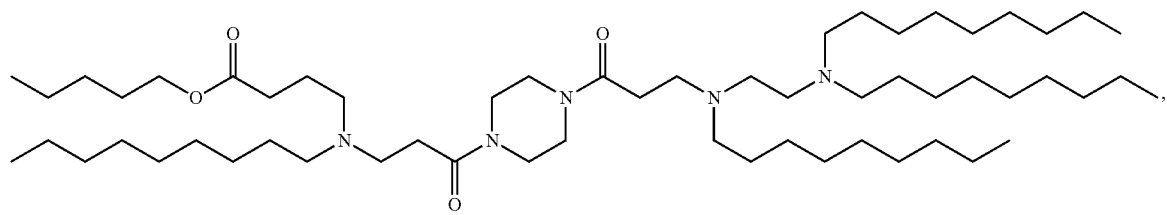
(Compound 295)
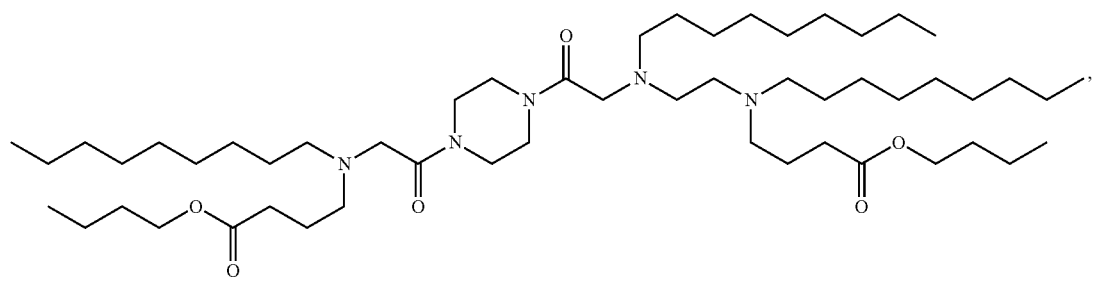
(Compound 296)
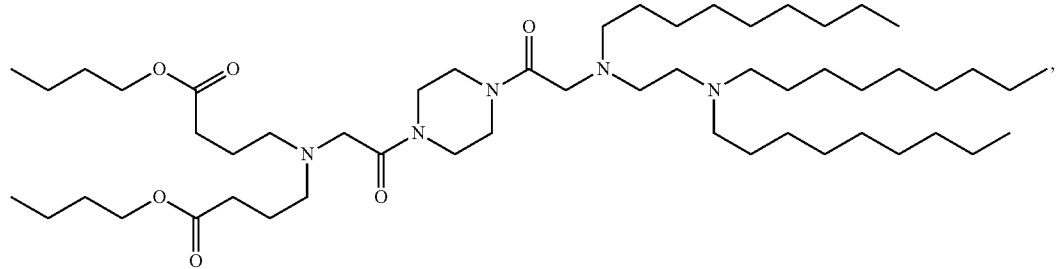
(Compound 297)
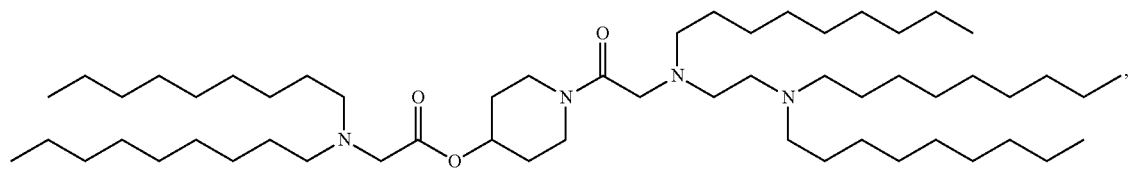
(Compound 298)
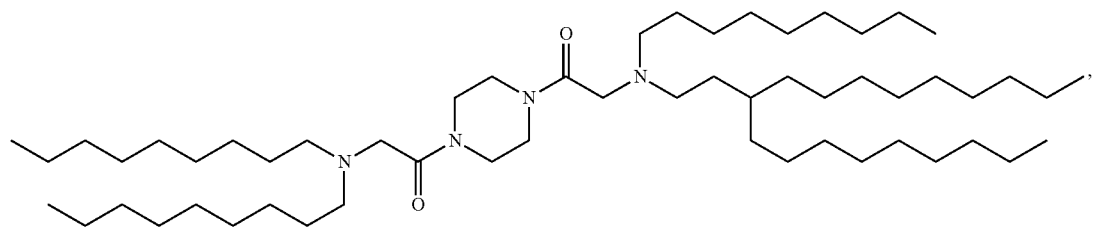

-continued
(Compound 300)
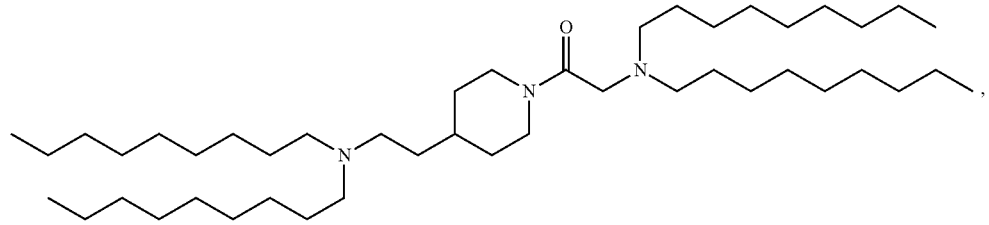
(Compound 301)
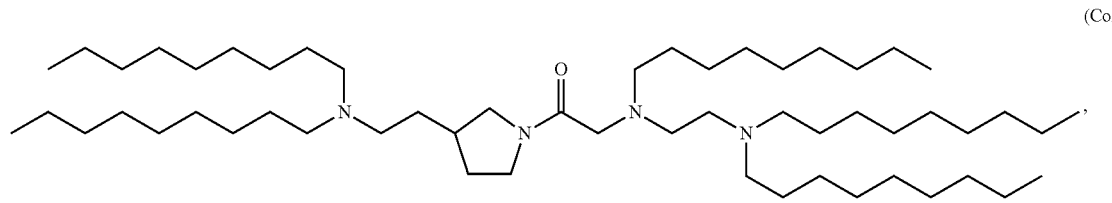
(Compound 302)
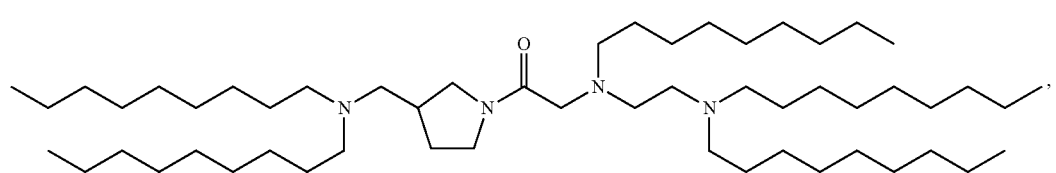
(Compound 303)
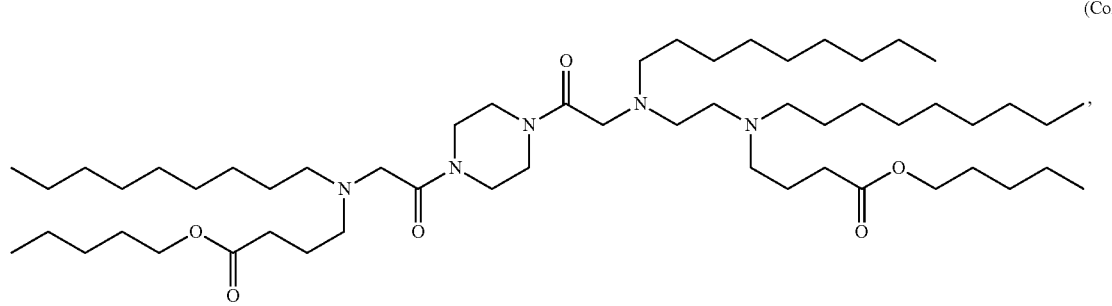
(Compound 304)
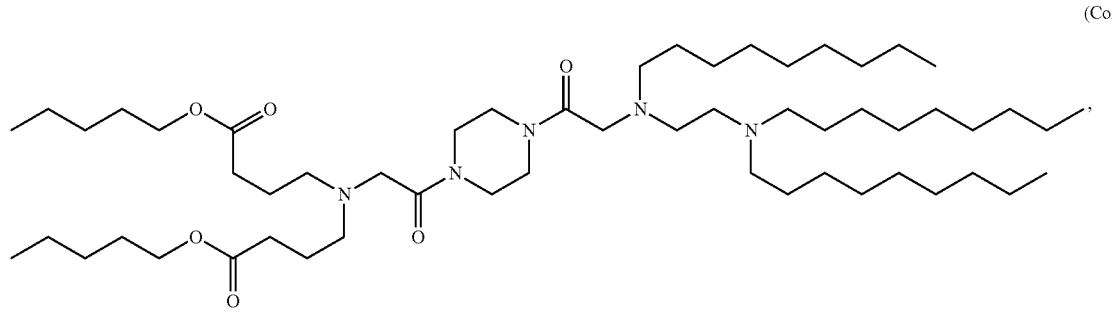
(Compound 305)
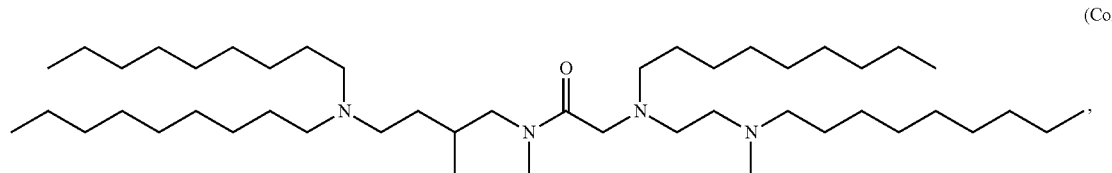
(Compound 306)
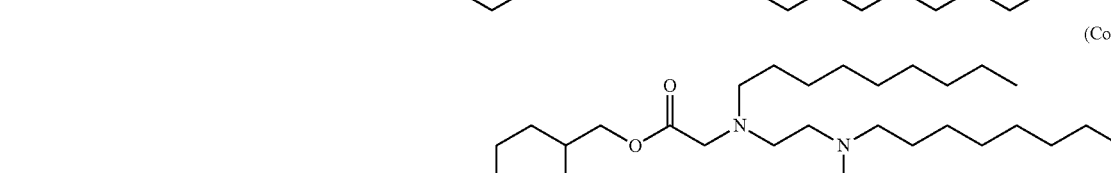

-continued
(Compound 307)
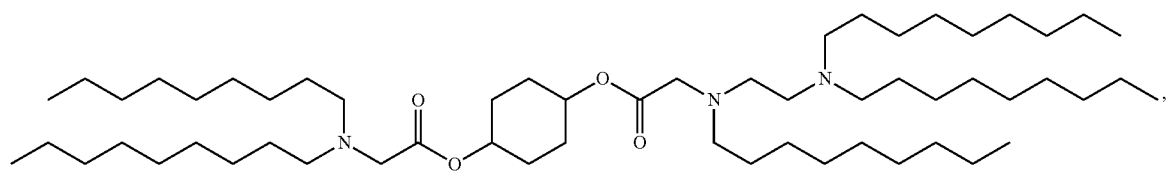
(Compound 308)
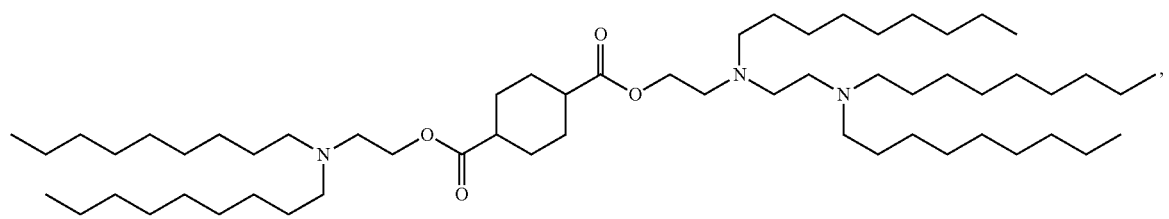
(Compound 310)
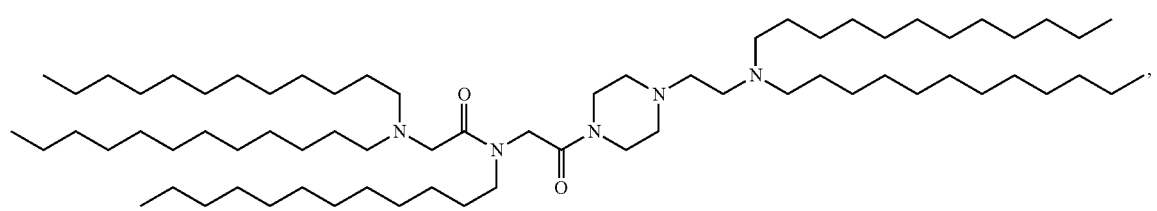
(Compound 311)
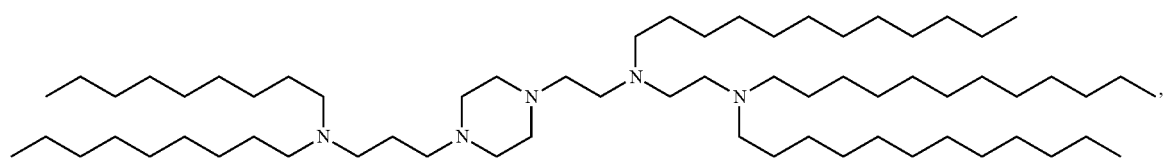
(Compound 312)
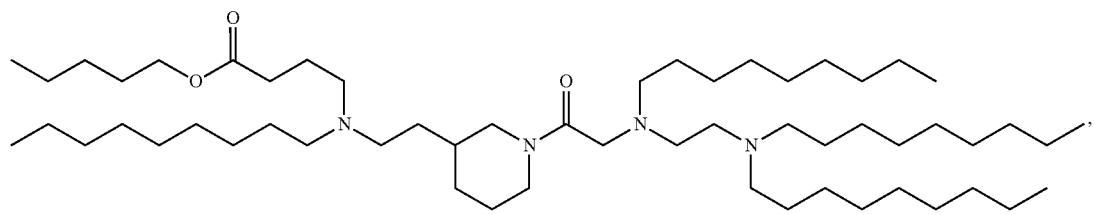
(Compound 313)
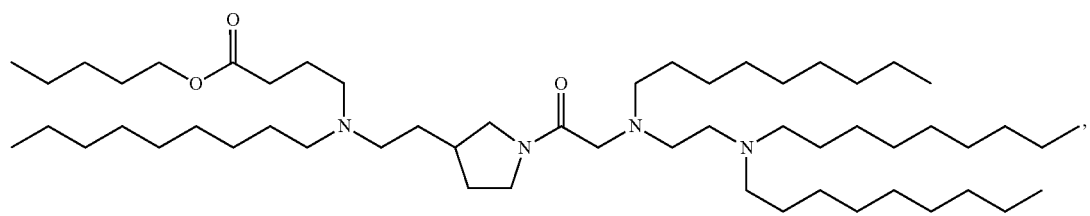
(Compound 314)
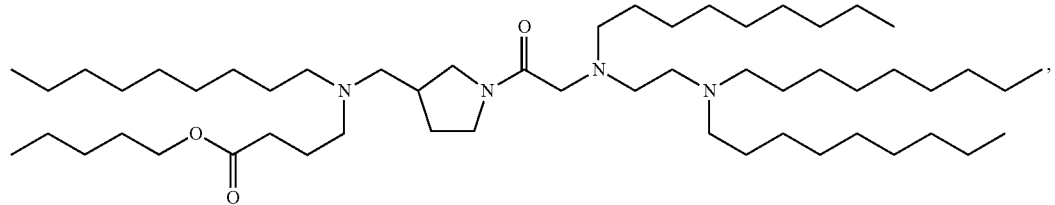

-continued
(Compound 315)
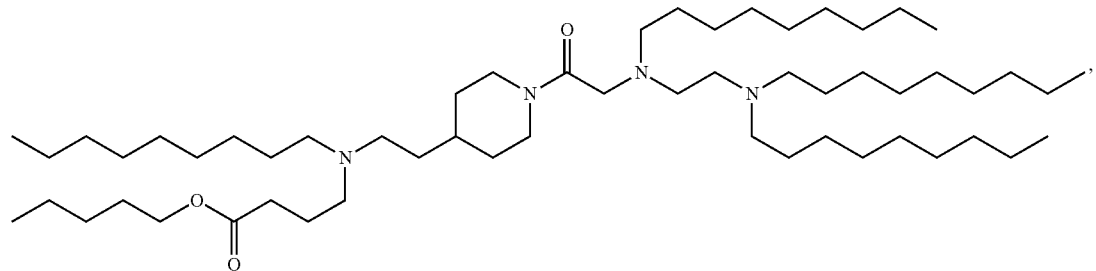
(Compound 316)
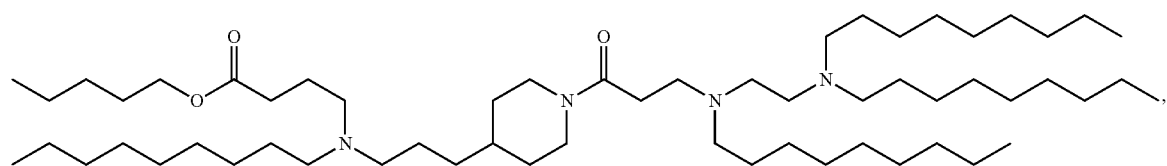
(Compound 317)
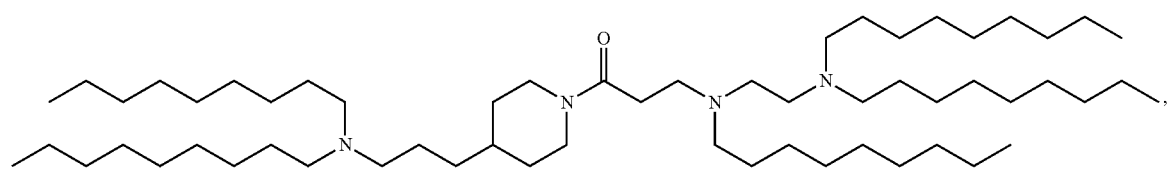
(Compound 318)
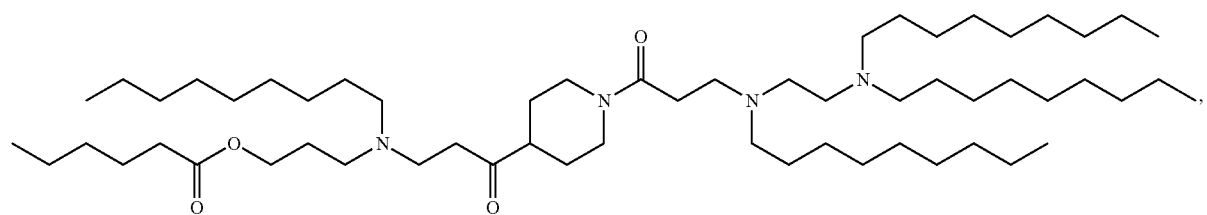
(Compound 319)
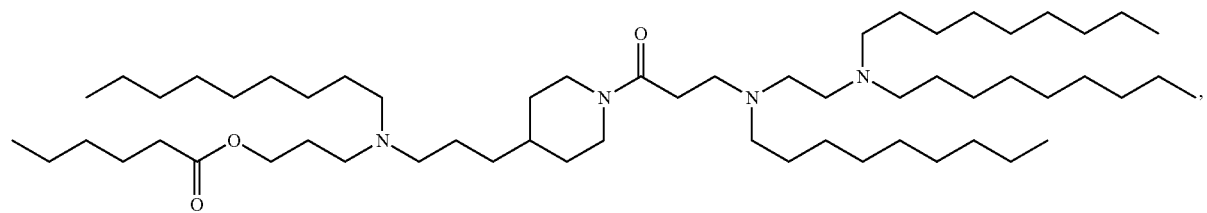
(Compound 320)
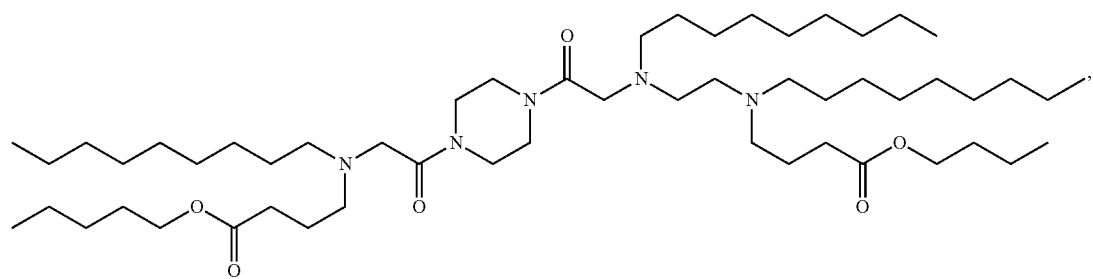

-continued
(Compound 321)
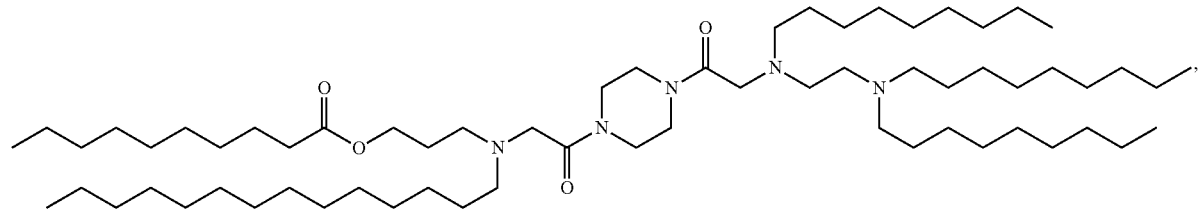
(Compound 322)
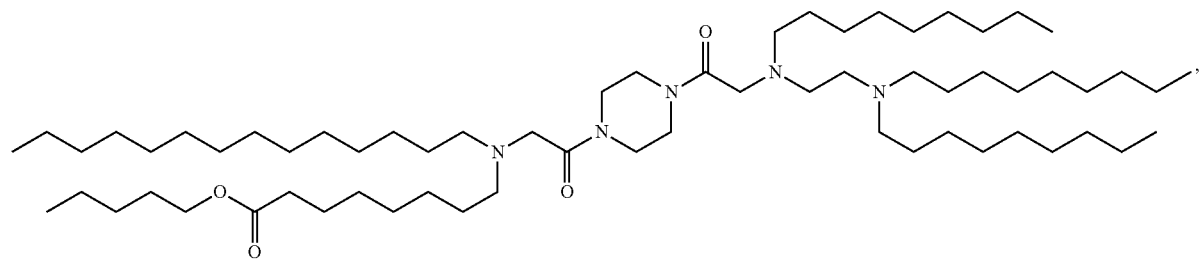
(Compound 323)
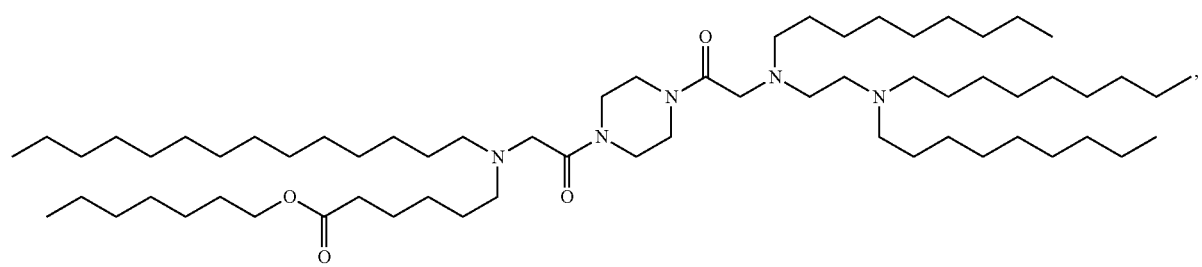
(Compound 324)
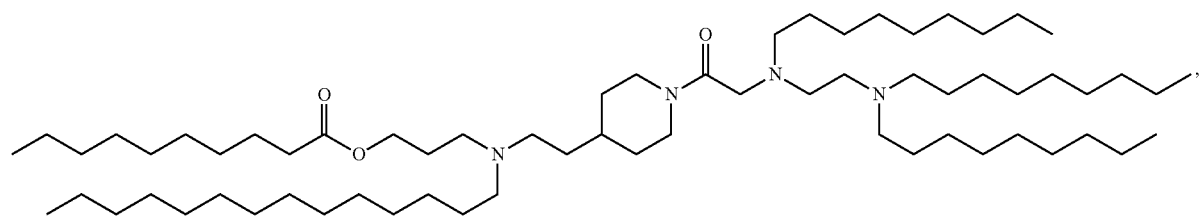
(Compound 325)
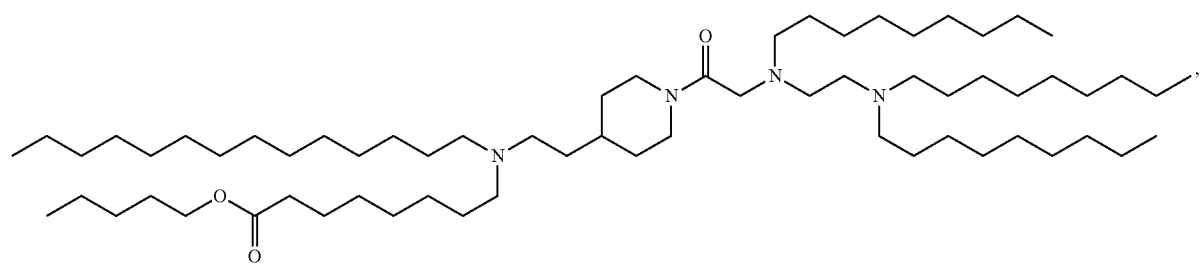
(Compound 326)
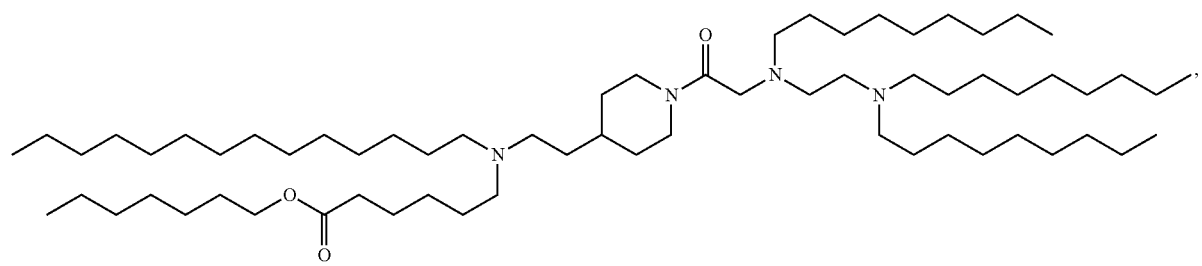

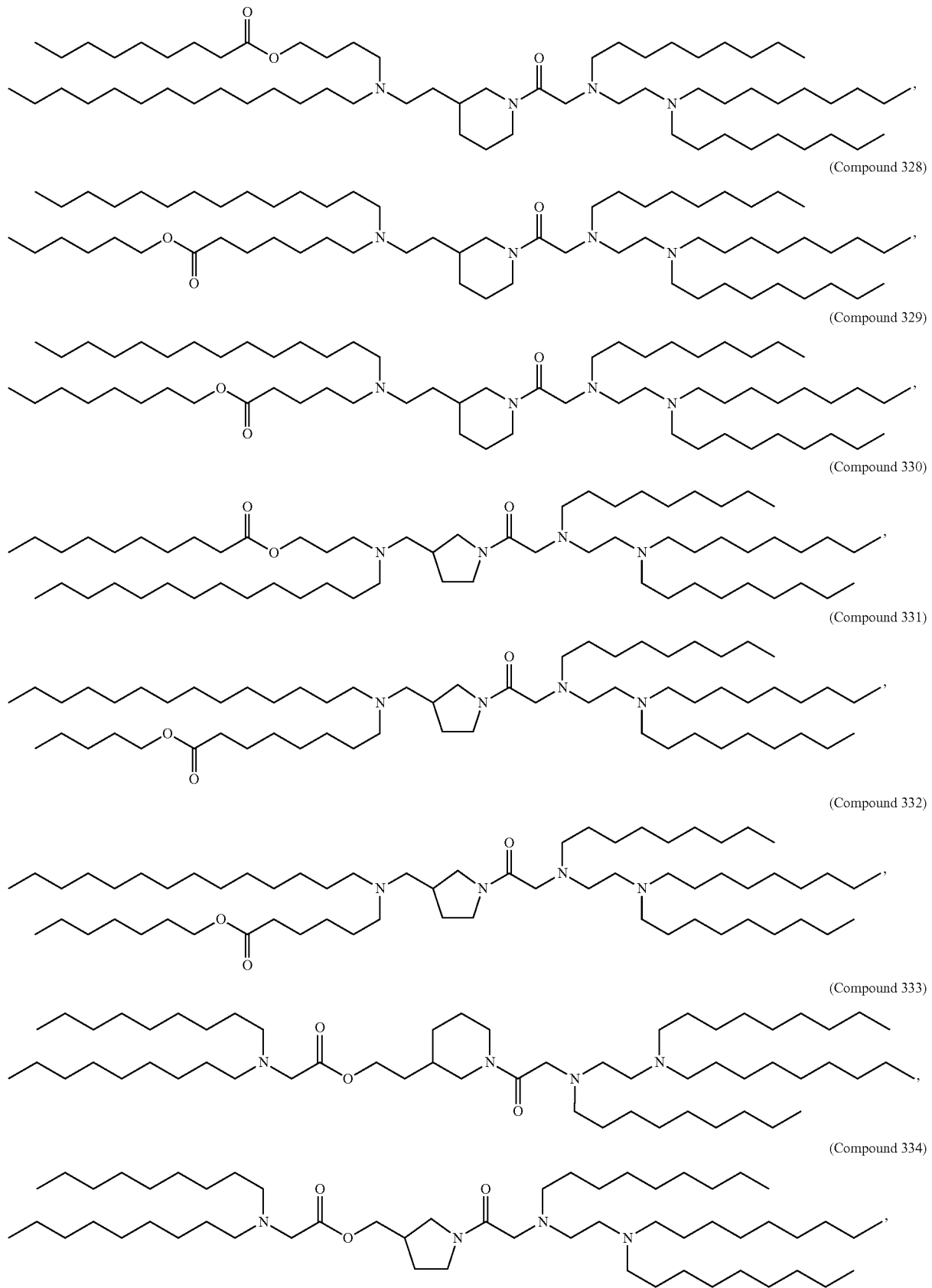

(Compound 335)
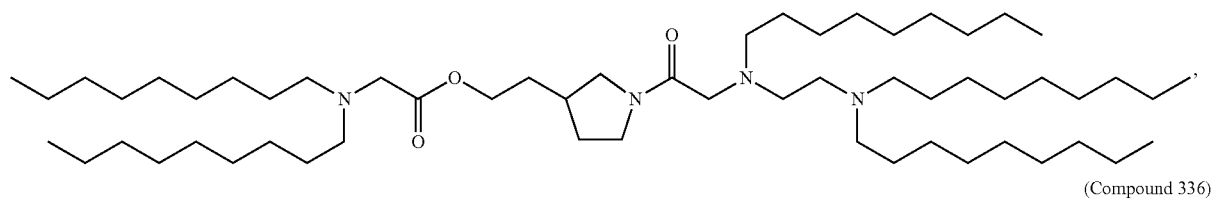
(Compound 336)
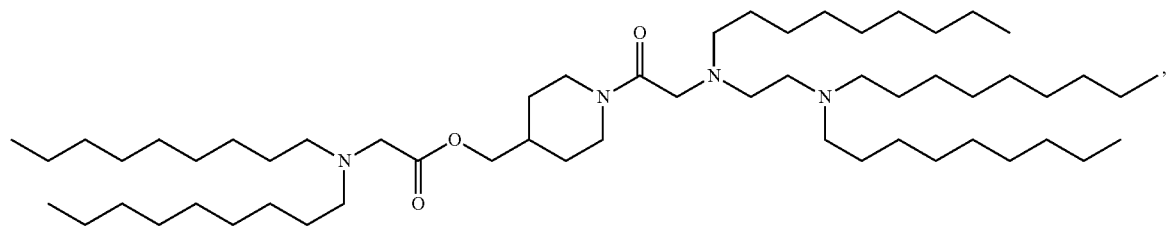
(Compound 337)
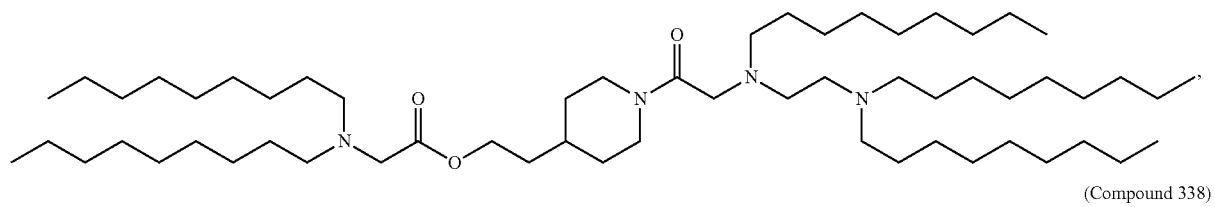
(Compound 338)
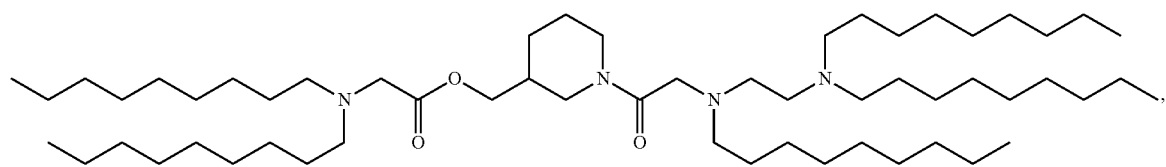
(Compound 339)
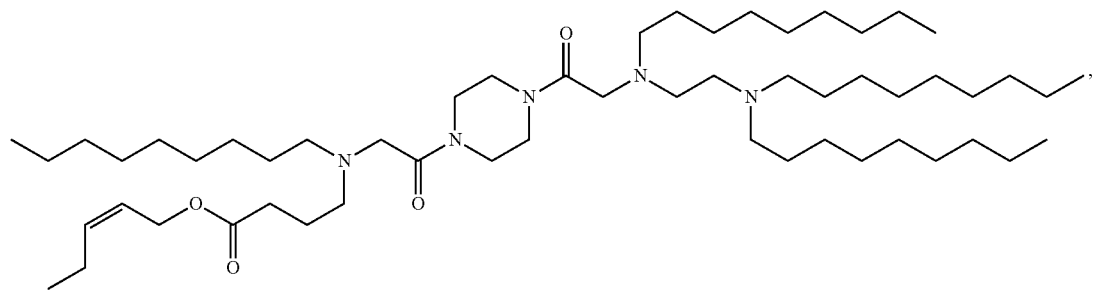
(Compound 340)
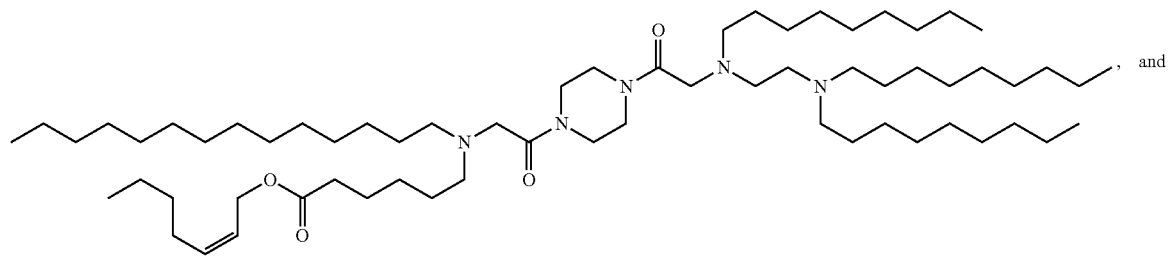
, and (Compound 341)

[Chemical structure of Compound 341]

In some embodiments, the delivery agent comprises Compound 236.

In some embodiments, the delivery agent comprises a compound having the Formula (IV)

(IV)

[Chemical structure of Formula (IV)]

or salts or stereoisomer thereof, wherein $A_1$ and $A_2$ are each independently selected from CH or N and at least one of $A_1$ and $A_2$ is N;

Z is $CH_2$ or absent wherein when Z is $CH_2$, the dashed lines (1) and (2) each represent a single bond; and when Z is absent, the dashed lines (1) and (2) are both absent;

$R_1$, $R_2$, $R_3$, $R_4$, and $R_5$ are independently selected from the group consisting of $C_{6-20}$ alkyl and $C_{6-20}$ alkenyl;

wherein when ring A is

[Chemical structure of piperazine ring]

then i) $R_1$, $R_2$, $R_3$, $R_4$, and $R_5$ are the same, wherein $R_1$ is not $C_{12}$ alkyl, $C_{18}$ alkyl, or $C_{18}$ alkenyl;

ii) only one of $R_1$, $R_2$, $R_3$, $R_4$, and $R_5$ is selected from $C_{6-20}$ alkenyl;

iii) at least one of $R_1$, $R_2$, $R_3$, $R_4$, and $R_5$ have a different number of carbon atoms than at least one other of $R_1$, $R_2$, $R_3$, $R_4$, and $R_5$;

iv) $R_1$, $R_2$, and $R_3$ are selected from $C_{6-20}$ alkenyl, and $R_4$ and $R_5$ are selected from $C_{6-20}$ alkyl; or v) $R_1$, $R_2$, and $R_3$ are selected from $C_{6-20}$ alkyl, and $R_4$ and $R_5$ are selected from $C_{6-20}$ alkenyl.

In some embodiments, the compound is of Formula (IVa):

(IVa)

[Chemical structure of Formula (IVa)]

The compounds of Formula (IV) or (IVa) include one or more of the following features when applicable.

In some embodiments, Z is $CH_2$.
In some embodiments, Z is absent.
In some embodiments, at least one of $A_1$ and $A_2$ is N.
In some embodiments, each of $A_1$ and $A_2$ is N.
In some embodiments, each of $A_1$ and $A_2$ is CH.
In some embodiments, $A_1$ is N and $A_2$ is CH.
In some embodiments, $A_1$ is CH and $A_2$ is N.

In some embodiments, $R_1$, $R_2$, $R_3$, $R_4$, and $R_5$ are the same, and are not $C_{12}$ alkyl, $C_{18}$ alkyl, or $C_{18}$ alkenyl. In some embodiments, $R_1$, $R_2$, $R_3$, $R_4$, and $R_5$ are the same and are $C_9$ alkyl or $C_{14}$ alkyl.

In some embodiments, only one of $R_1$, $R_2$, $R_3$, $R_4$, and $R_5$ is selected from $C_{6-20}$ alkenyl.

In certain such embodiments, $R_1$, $R_2$, $R_3$, $R_4$, and $R_5$ have the same number of carbon atoms.

In some embodiments, $R_4$ is selected from $C_{5-20}$ alkenyl. For example, $R_4$ may be $C_{12}$ alkenyl or $C_{18}$ alkenyl.

In some embodiments, at least one of $R_1$, $R_2$, $R_3$, $R_4$, and $R_5$ have a different number of carbon atoms than at least one other of $R_1$, $R_2$, $R_3$, $R_4$, and $R_5$.

In certain embodiments, $R_1$, $R_2$, and $R_3$ are selected from $C_{6-20}$ alkenyl, and $R_4$ and $R_5$ are selected from $C_{6-20}$ alkyl. In other embodiments, $R_1$, $R_2$, and $R_3$ are selected from $C_{6-20}$ alkyl, and $R_4$ and $R_5$ are selected from $C_{6-20}$ alkenyl. In some embodiments, $R_1$, $R_2$, and $R_3$ have the same number of carbon atoms, and/or $R_4$ and $R_5$ have the same number of carbon atoms. For example, $R_1$, $R_2$, and $R_3$, or $R_4$ and $R_5$, may have 6, 8, 9, 12, 14, or 18 carbon atoms. In some embodiments, $R_1$, $R_2$, and $R_3$, or $R_4$ and $R_5$, are $C_{18}$ alkenyl (e.g., linoleyl). In some embodiments, $R_1$, $R_2$, and $R_3$, or $R_4$ and $R_5$, are alkyl groups including 6, 8, 9, 12, or 14 carbon atoms.

In some embodiments, $R_1$ has a different number of carbon atoms than $R_2$, $R_3$, $R_4$, and $R_5$. In other embodiments, $R_3$ has a different number of carbon atoms than $R_1$, $R_2$, $R_4$, and $R_5$. In further embodiments, $R_4$ has a different number of carbon atoms than $R_1$, $R_2$, $R_3$, and $R_5$.

In some embodiments, the compound is selected from the group consisting of:

(Compound 249)
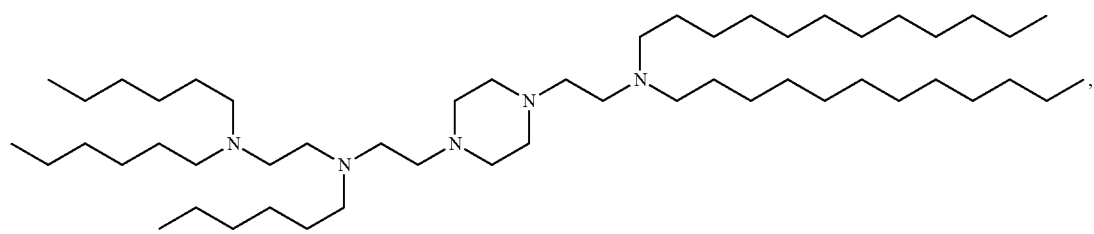
(Compound 250)
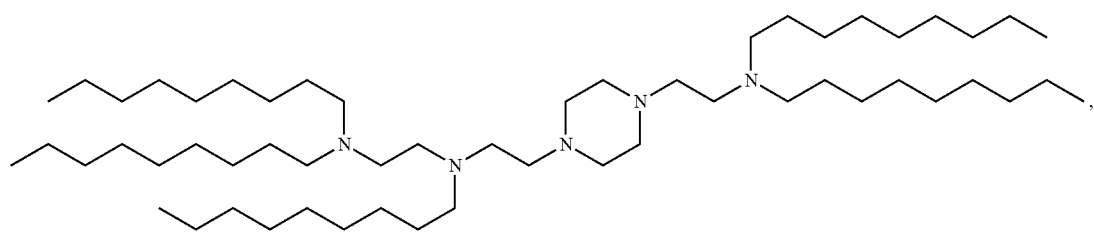
(Compound 251)
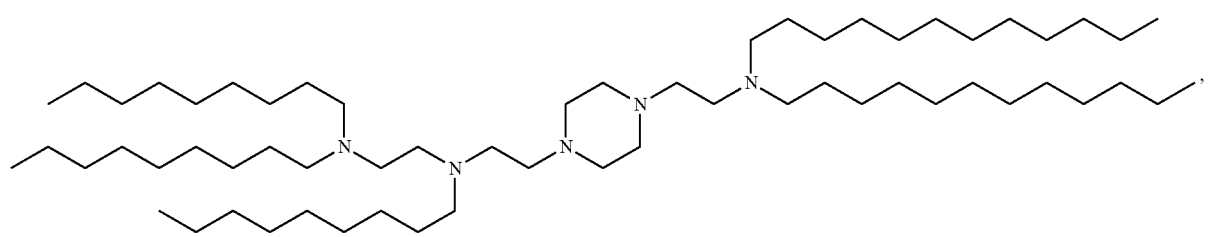
(Compound 252)
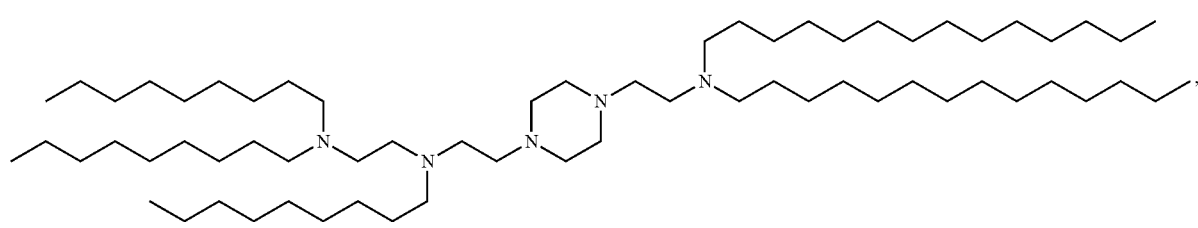
(Compound 253)
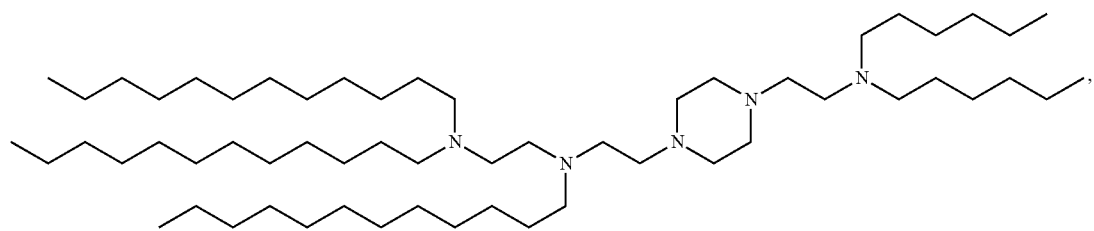
(Compound 254)
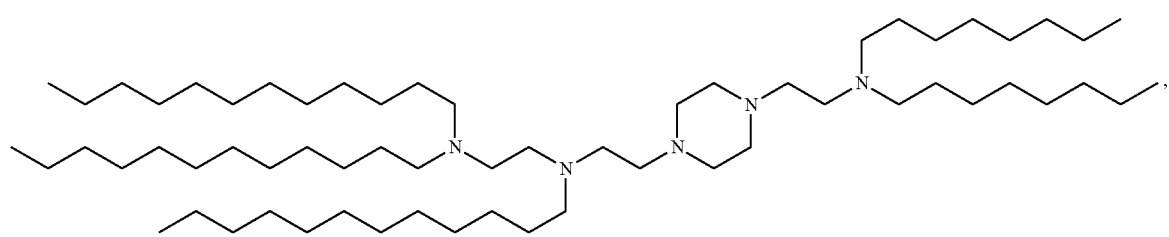

(Compound 255)
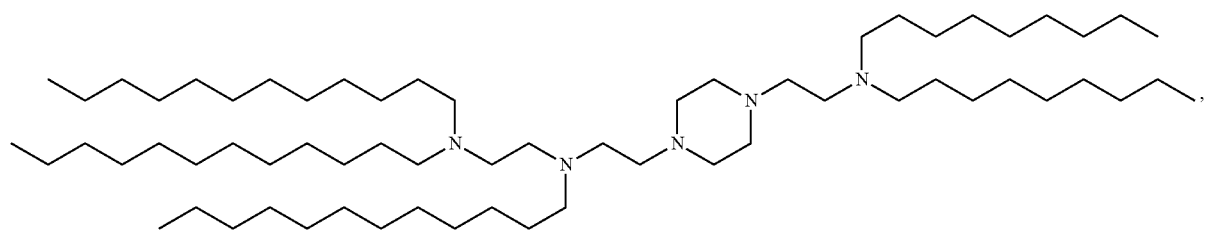
(Compound 256)
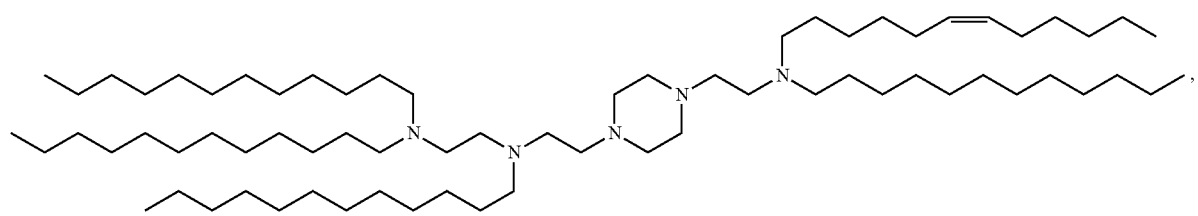
(Compound 257)
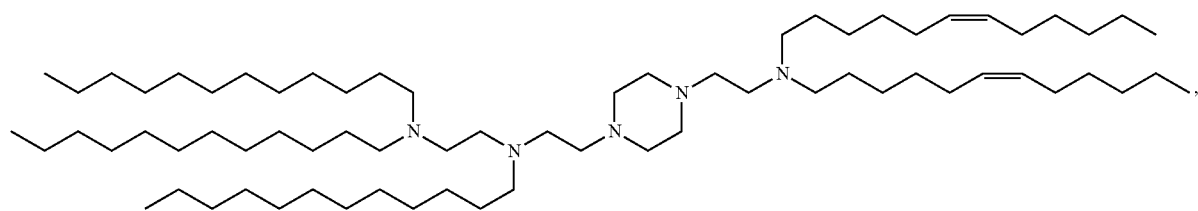
(Compound 258)
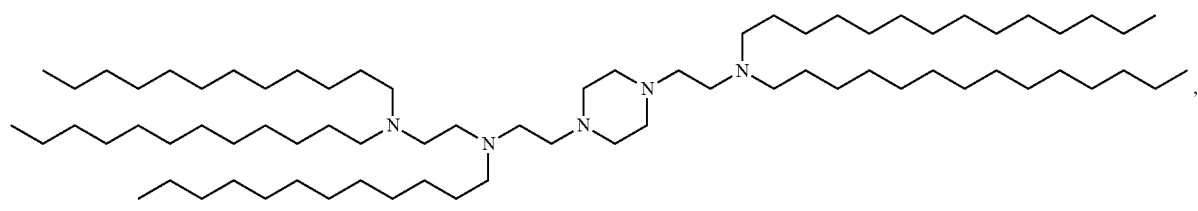
(Compound 259)
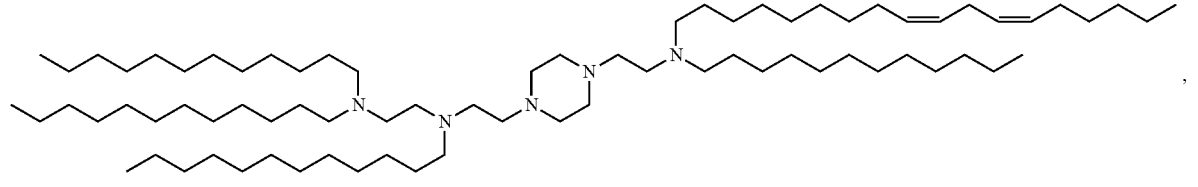
(Compound 260)
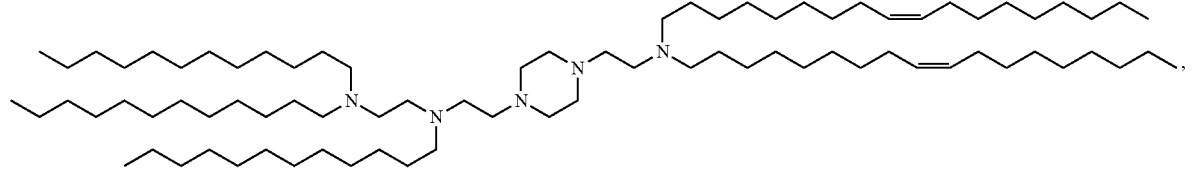
(Compound 261)
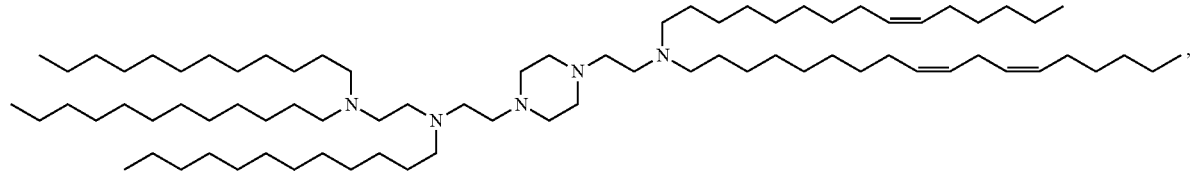

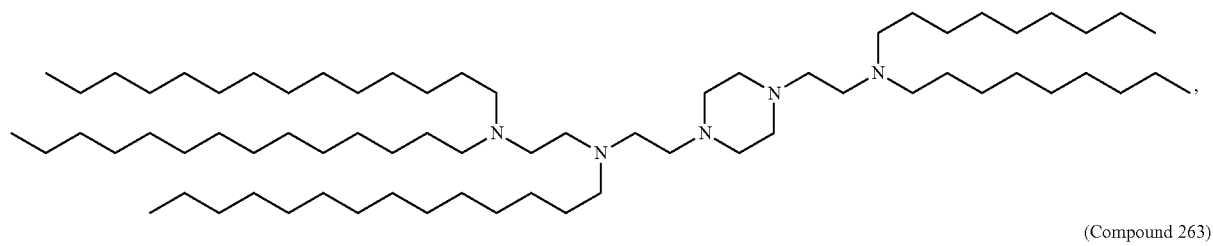
(Compound 262)

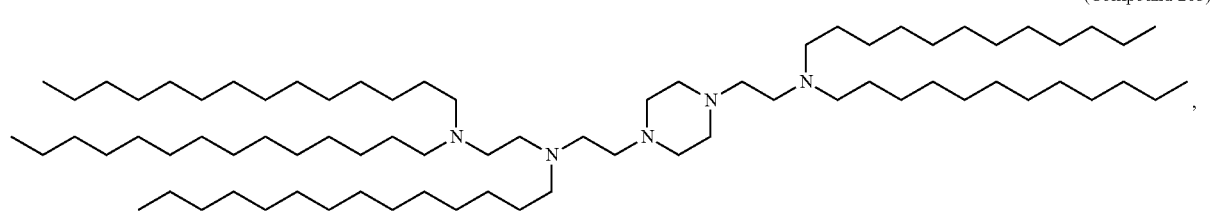
(Compound 263)

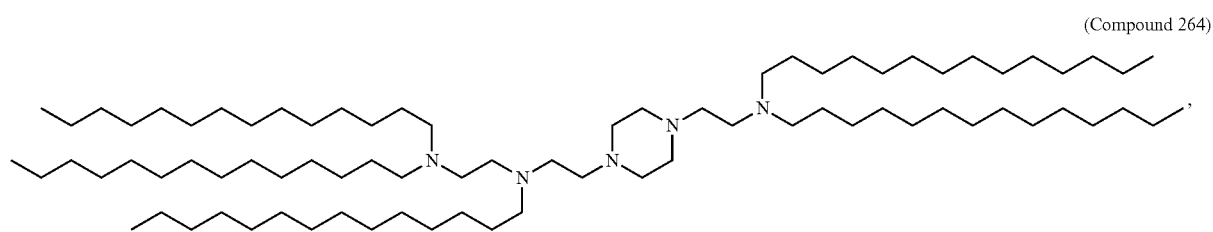
(Compound 264)

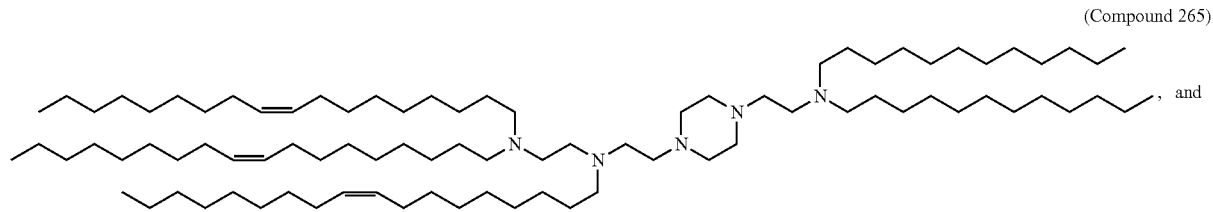
(Compound 265), and

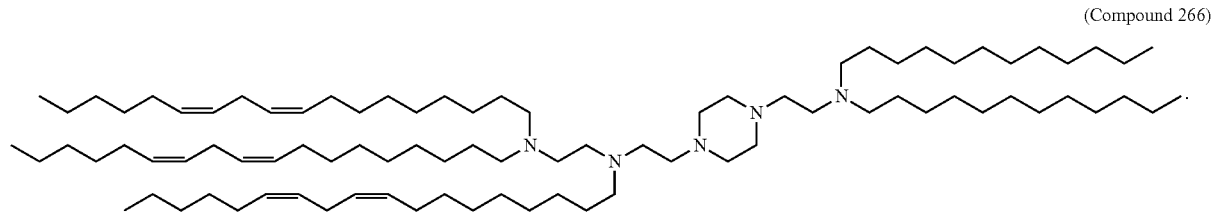
(Compound 266)

In other embodiments, the delivery agent comprises a compound having the Formula (V)

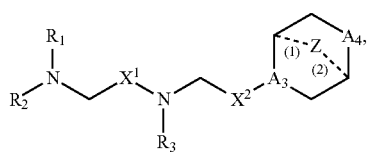
(V)

or salts or stereoisomers thereof, in which
$A_3$ is CH or N;
$A_4$ is $CH_2$ or NH; and at least one of $A_3$ and $A_4$ is N or NH;
Z is $CH_2$ or absent wherein when Z is $CH_2$, the dashed lines (1) and (2) each represent a single bond; and when Z is absent, the dashed lines (1) and (2) are both absent;
$R_1$, $R_2$, and $R_3$ are independently selected from the group consisting of $C_{5-20}$ alkyl, $C_{5-20}$ alkenyl, —R"MR', —R*YR", —YR", and —R*OR";

each M is independently selected from C(O)O, OC(O), C(O)N(R'), N(R')C(O), C(O), —C(S), C(S)S, SC(S), CH(OH), P(O)(OR')O, S(O)$_2$, an aryl group, and a heteroaryl group;

$X^1$ and $X^2$ are independently selected from the group consisting of $CH_2$, $(CH_2)_2$, CHR, —CHY, C(O), C(O)O, OC(O), —C(O)—$CH_2$—, —$CH_2$—C(O)—, C(O)OCH$_2$, OC(O)CH$_2$, $CH_2$—C(O)O, $CH_2$OC(O), CH(OH), C(S), and CH(SH);

each Y is independently a $C_{3-6}$ carbocycle;
each R* is independently selected from the group consisting of $C_{1-12}$ alkyl and $C_{2-12}$ alkenyl;
each R is independently selected from the group consisting of $C_{1-3}$ alkyl and a $C_{3-6}$ carbocycle;
each R' is independently selected from the group consisting of $C_{1-12}$ alkyl, $C_{2-12}$ alkenyl, and H; and
each R" is independently selected from the group consisting of $C_{3-12}$ alkyl and $C_{3-12}$ alkenyl.

In some embodiments, the compound is of Formula (Va):

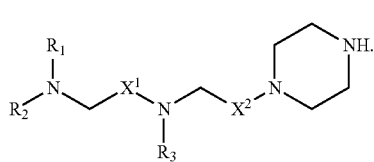
(Va)

The compounds of Formula (V) or (Va) include one or more of the following features when applicable.

In some embodiments, Z is $CH_2$.
In some embodiments, Z is absent.
In some embodiments, at least one of $A_3$ and $A_4$ is N or NH.
In some embodiments, $A_3$ is N and $A_4$ is NH.

In some embodiments, $A_3$ is N and $A_4$ is $CH_2$.
In some embodiments, $A_3$ is CH and $A_4$ is NH.
In some embodiments, at least one of $X^1$ and $X^2$ is not —$CH_2$—. For example, in certain embodiments, $X^1$ is not —$CH_2$—. In some embodiments, at least one of $X^1$ and $X^2$ is —C(O)—.

In some embodiments, $X^2$ is —C(O)—, C(O)O, OC(O), —C(O)—$CH_2$—, —$CH_2$—C(O)—, C(O)O—$CH_2$, OC(O)—$CH_2$, $CH_2$—C(O)O, or $CH_2$—OC(O).

In some embodiments, $R_1$, $R_2$, and $R_3$ are independently selected from the group consisting of $C_{5-20}$ alkyl and $C_{5-20}$ alkenyl. In some embodiments, $R_1$, $R_2$, and $R_3$ are the same. In certain embodiments, $R_1$, $R_2$, and $R_3$ are $C_6$, $C_9$, $C_{12}$, or $C_{14}$ alkyl. In other embodiments, $R_1$, $R_2$, and $R_3$ are $C_{18}$ alkenyl. For example, $R_1$, $R_2$, and $R_3$ may be linoleyl.

In some embodiments, the compound is selected from the group consisting of:

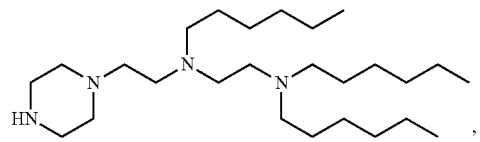
(Compound 267)

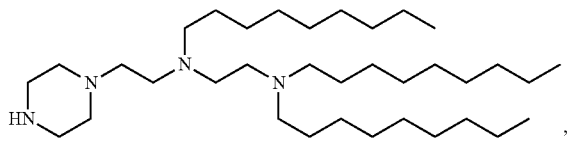
(Compound 268)

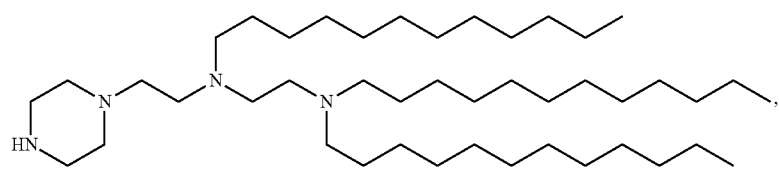
(Compound 269)

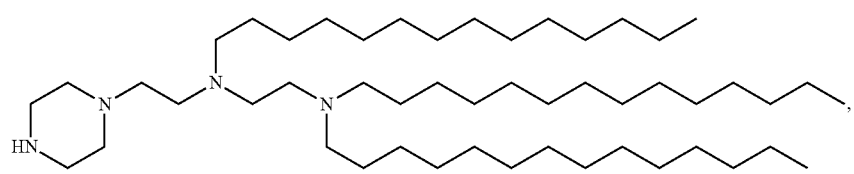
(Compound 270)

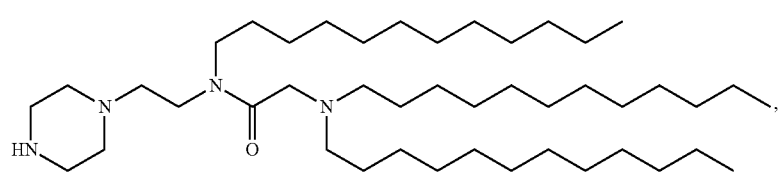
(Compound 271)

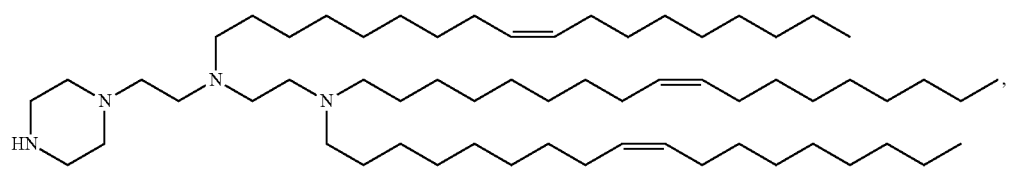
(Compound 272)

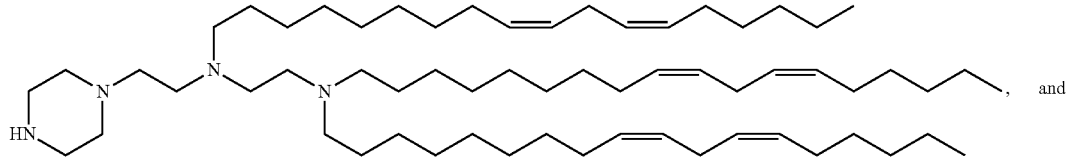
(Compound 273)

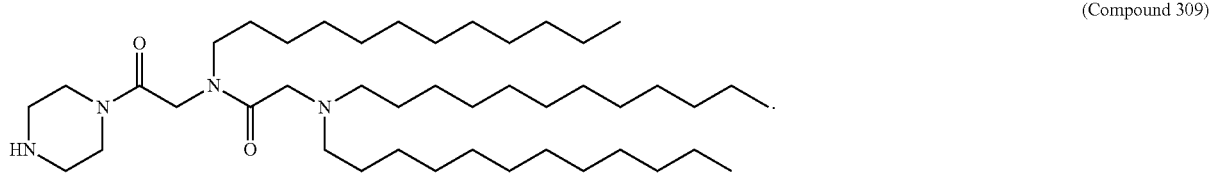
(Compound 309)

In other embodiments, the delivery agent comprises a compound having the Formula (VI):

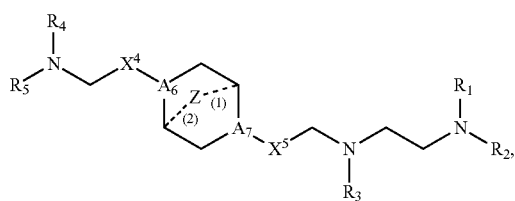
(VI)

or salts or stereoisomers thereof, in which $A_6$ and $A_7$ are each independently selected from CH or N, wherein at least one of $A_6$ and $A_7$ is N;

Z is $CH_2$ or absent wherein when Z is $CH_2$, the dashed lines (1) and (2) each represent a single bond; and when Z is absent, the dashed lines (1) and (2) are both absent;

$X^4$ and $X^5$ are independently selected from the group consisting of —$CH_2$—, $CH_2)_2$-, CHR, CHY, C(O), C(O)O, OC(O), —C(O)—$CH_2$—, —$CH_2$—C(O)—, C(O)O$CH_2$, OC(O)—$CH_2$, $CH_2$—C(O)O, $CH_2$—OC(O), CH(OH), C(S), and CH(SH);

$R_1$, $R_2$, $R_3$, $R_4$, and $R_5$ each are independently selected from the group consisting of $C_{5-20}$ alkyl, $C_{5-20}$ alkenyl, —R"MR', —R*YR", —YR", and —R*OR";

each M is independently selected from the group consisting of C(O)O, OC(O), —C(O)N(R'), N(R')C(O), C(O), C(S), C(S)S, SC(S), CH(OH), P(O)(OR')O, S(O)$_2$ an aryl group, and a heteroaryl group;

each Y is independently a $C_{3-6}$ carbocycle;

each R* is independently selected from the group consisting of $C_{1-12}$ alkyl and $C_{2{-}12}$ alkenyl;

each R is independently selected from the group consisting of $C_{1-3}$ alkyl and a $C_{3-6}$ carbocycle;

each R' is independently selected from the group consisting of $C_{1-12}$ alkyl, $C_{2-12}$ alkenyl, and H; and each R" is independently selected from the group consisting of $C_{3-12}$ alkyl and $C_{3{-}12}$ alkenyl.

In some embodiments, $R_1$, $R_2$, $R_3$, $R_4$, and $R_5$ each are independently selected from the group consisting of $C_{6-20}$ alkyl and $C_{6-20}$ alkenyl.

In some embodiments, $R_1$ and $R_2$ are the same. In certain embodiments, $R_1$, $R_2$, and $R_3$ are the same. In some embodiments, $R_4$ and $R_5$ are the same. In certain embodiments, $R_1$, $R_2$, $R_3$, $R_4$, and $R_5$ are the same.

In some embodiments, at least one of $R_1$, $R_2$, $R_3$, $R_4$, and $R_5$ is $C_{9-12}$ alkyl. In certain embodiments, each of $R_1$, $R_2$, $R_3$, $R_4$, and $R_5$ independently is $C_9$, $C_{12}$ or $C_{14}$ alkyl. In certain embodiments, each of $R_1$, $R_2$, $R_3$, $R_4$, and $R_5$ is $C_9$ alkyl.

In some embodiments, $A_6$ is N and $A_7$ is N. In some embodiments, $A_6$ is CH and $A_7$ is N.

In some embodiments, $X^4$ is-$CH_2$— and $X^5$ is —C(O)—. In some embodiments, $X^4$ and $X^5$ are —C(O)—.

In some embodiments, when $A_6$ is N and $A_7$ is N, at least one of $X^4$ and $X^5$ is not —$CH_2$—, e.g., at least one of $X^4$ and $X^5$ is —C(O)—. In some embodiments, when $A_6$ is N and $A_7$ is N, at least one of $R_1$, $R_2$, $R_3$, $R_4$, and $R_5$ is —R"MR'.

In some embodiments, at least one of $R_1$, $R_2$, $R_3$, $R_4$, and $R_5$ is not —R"MR'.

In some embodiments, the compound is

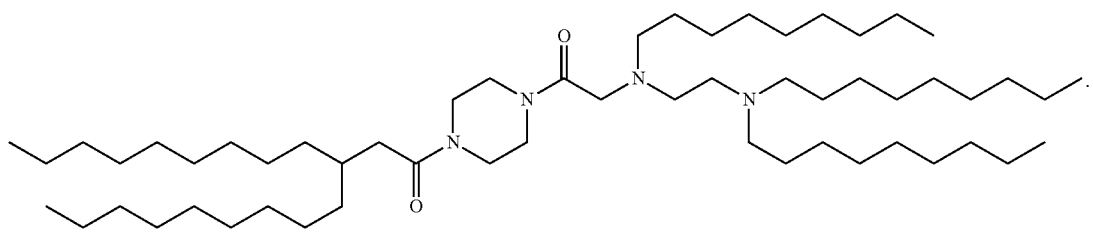
(Compound 299)

In other embodiments, the delivery agent comprises a compound having the formula:

(Compound 342)

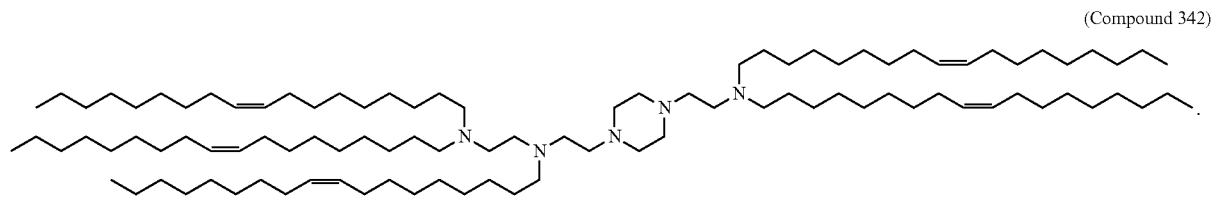 [SMILES: CCCCCCCC/C=C\CCCCCCCCN(CCCCCCCC/C=C\CCCCCCCC)CCN(CCCCCCCC/C=C\CCCCCCCC)CCN1CCN(CCN(CCCCCCCC/C=C\CCCCCCCC)CCCCCCCC/C=C\CCCCCCCC)CC1]

Amine moieties of the lipid compounds disclosed herein can be protonated under certain conditions. For example, the central amine moiety of a lipid according to Formula (I) is typically protonated (i.e., positively charged) at a pH below the pKa of the amino moiety and is substantially not charged at a pH above the pKa. Such lipids can be referred to ionizable amino lipids.

In one specific embodiment, the ionizable amino lipid is Compound 18. In another embodiment, the ionizable amino lipid is Compound 236.

In some embodiments, the amount the ionizable amino lipid, e.g., compound of Formula (I) ranges from about 1 mol % to 99 mol % in the lipid composition.

In one embodiment, the amount of the ionizable amino lipid, e.g., compound of Formula (I) is at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 mol % in the lipid composition.

In one embodiment, the amount of the ionizable amino lipid, e.g., the compound of Formula (I) ranges from about 30 mol % to about 70 mol %, from about 35 mol % to about 65 mol %, from about 40 mol % to about 60 mol %, and from about 45 mol % to about 55 mol % in the lipid composition.

In one specific embodiment, the amount of the ionizable amino lipid, e.g., compound of Formula (I) is about 50 mol % in the lipid composition.

In addition to the ionizable amino lipid disclosed herein, e.g., compound of Formula (I), the lipid composition of the pharmaceutical compositions disclosed herein can comprise additional components such as phospholipids, structural lipids, PEG-lipids, and any combination thereof.

b. Additional Components in the Lipid Composition
(i) Phospholipids

The lipid composition of the pharmaceutical composition disclosed herein can comprise one or more phospholipids, for example, one or more saturated or (poly)unsaturated phospholipids or a combination thereof. In general, phospholipids comprise a phospholipid moiety and one or more fatty acid moieties.

A phospholipid moiety can be selected, for example, from the non-limiting group consisting of phosphatidyl choline, phosphatidyl ethanolamine, phosphatidyl glycerol, phosphatidyl serine, phosphatidic acid, 2-lysophosphatidyl choline, and a sphingomyelin.

A fatty acid moiety can be selected, for example, from the non-limiting group consisting of lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, and docosahexaenoic acid.

Particular phospholipids can facilitate fusion to a membrane. For example, a cationic phospholipid can interact with one or more negatively charged phospholipids of a membrane (e.g., a cellular or intracellular membrane). Fusion of a phospholipid to a membrane can allow one or more elements (e.g., a therapeutic agent) of a lipid-containing composition (e.g., LNPs) to pass through the membrane permitting, e.g., delivery of the one or more elements to a target tissue.

Non-natural phospholipid species including natural species with modifications and substitutions including branching, oxidation, cyclization, and alkynes are also contemplated.

For example, a phospholipid can be functionalized with or cross-linked to one or more alkynes (e.g., an alkenyl group in which one or more double bonds is replaced with a triple bond). Under appropriate reaction conditions, an alkyne group can undergo a copper-catalyzed cycloaddition upon exposure to an azide. Such reactions can be useful in functionalizing a lipid bilayer of a nanoparticle composition to facilitate membrane permeation or cellular recognition or in conjugating a nanoparticle composition to a useful component such as a targeting or imaging moiety (e.g., a dye).

Phospholipids include, but are not limited to, glycerophospholipids such as phosphatidylcholines, phosphatidylethanolamines, phosphatidylserines, phosphatidylinositols, phosphatidy glycerols, and phosphatidic acids. Phospholipids also include phosphosphingolipid, such as sphingomyelin.

Examples of phospholipids include, but are not limited to, the following:

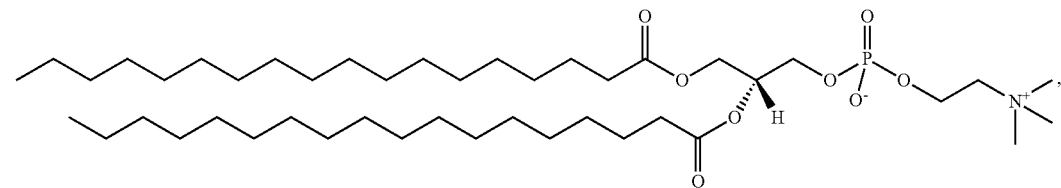

-continued
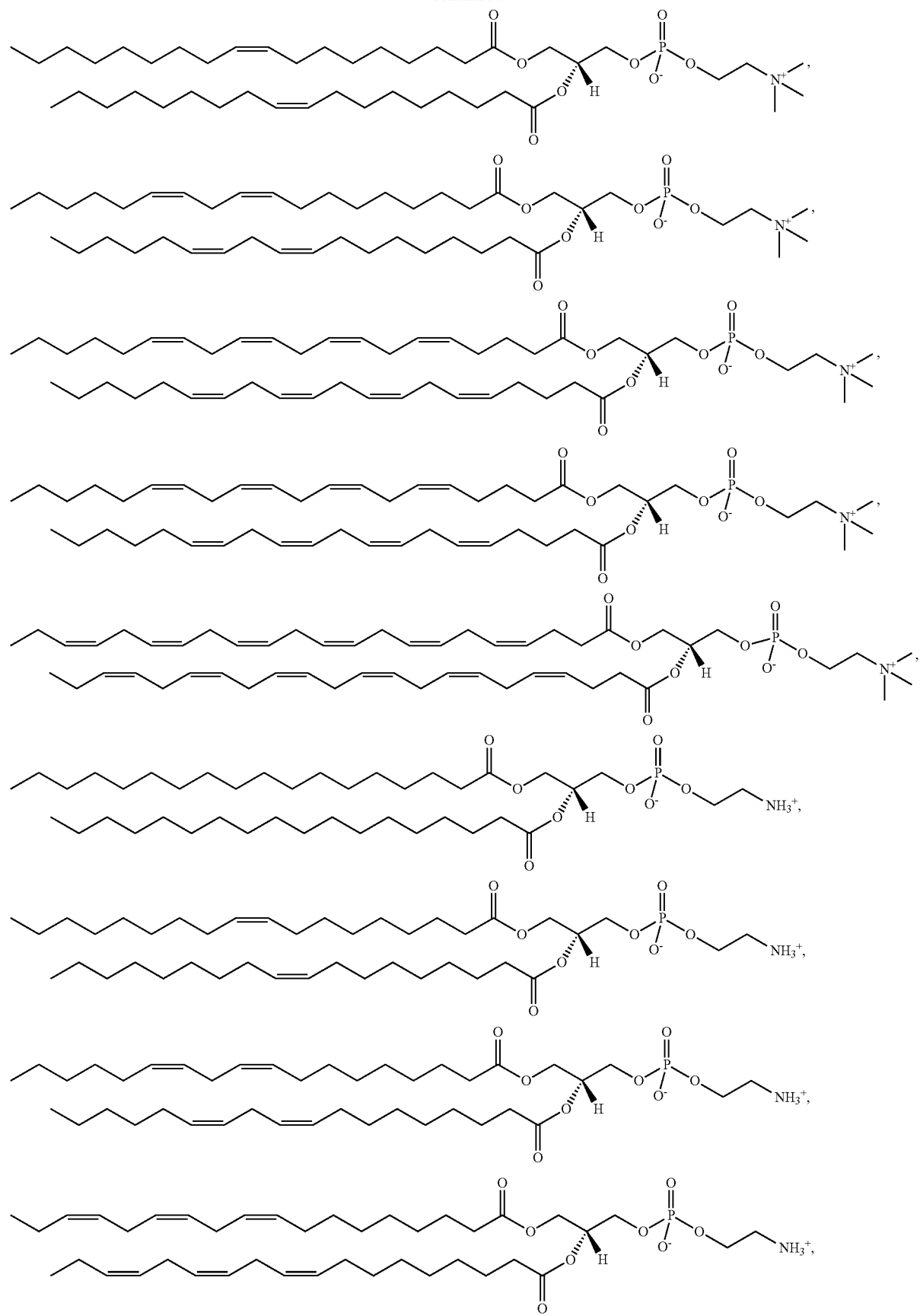

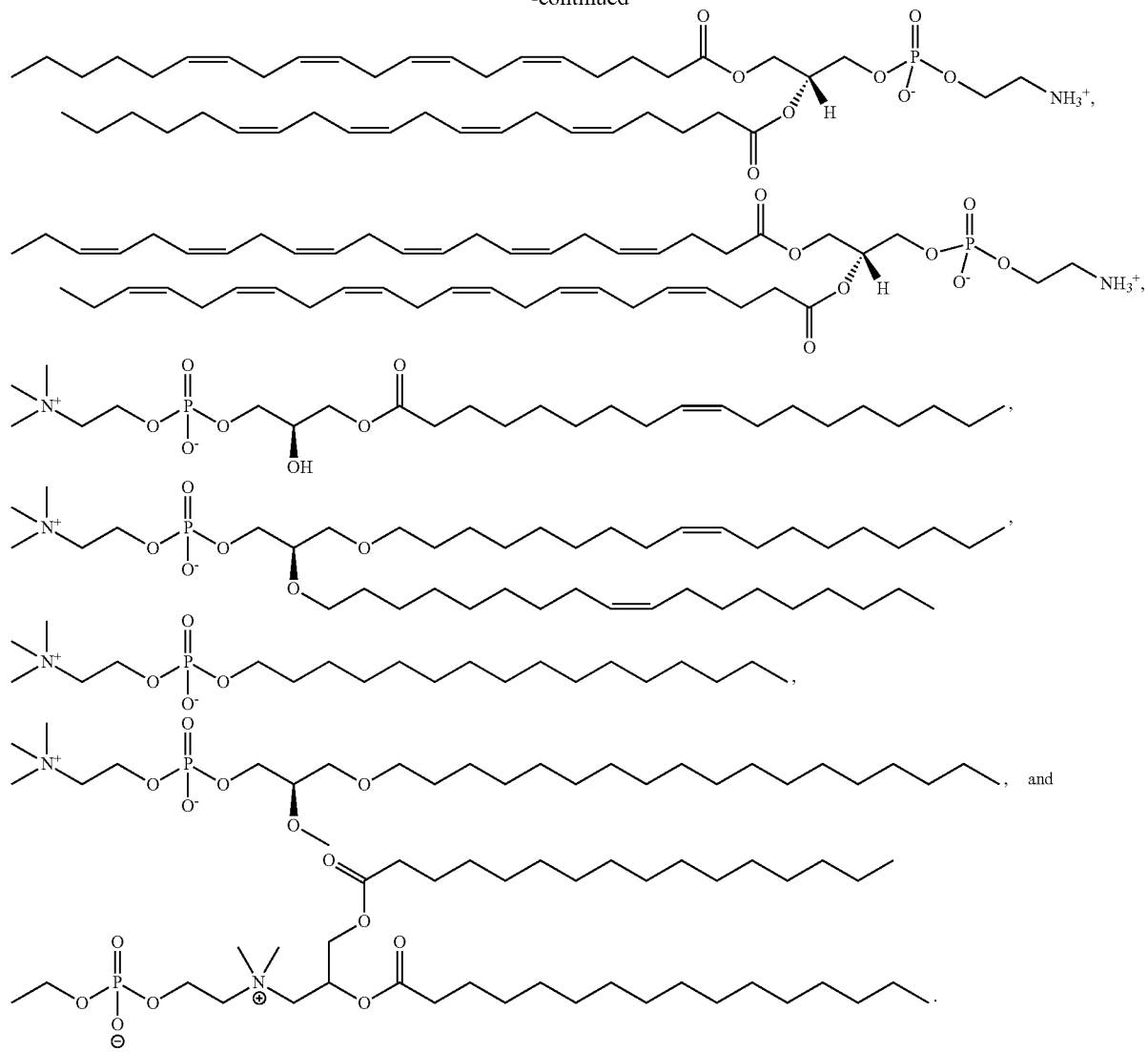

In certain embodiments, a phospholipid useful or potentially useful in the present invention is an analog or variant of DSPC. In certain embodiments, a phospholipid useful or potentially useful in the present invention is a compound of Formula (IX):

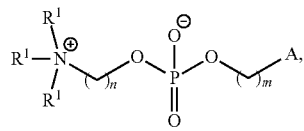

(IX)

or a salt thereof, wherein:

each $R^1$ is independently optionally substituted alkyl; or optionally two $R^1$ are joined together with the intervening atoms to form optionally substituted monocyclic carbocyclyl or optionally substituted monocyclic heterocyclyl; or optionally three $R^1$ are joined together with the intervening atoms to form optionally substituted bicyclic carbocyclyl or optionally substitute bicyclic heterocyclyl;

n is 1, 2, 3, 4, 5, 6, 7, 8, 9, or 10;
m is 0, 1, 2, 3, 4, 5, 6, 7, 8, 9, or 10;
A is of the formula:

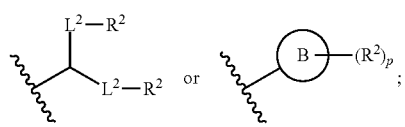

each instance of $L^2$ is independently a bond or optionally substituted $C_{1-6}$ alkylene, wherein one methylene unit of the optionally substituted $C_{1-6}$ alkylene is optionally replaced with O, N($R^N$), S, C(O), C(O)N($R^N$), $NR^NC(O)$, C(O)O, OC(O), OC(O)O, OC(O)N($R^N$), —$NR^NC(O)O$, or $NR^NC(O)N(R^N)$;

each instance of $R^2$ is independently optionally substituted $C_{1-30}$ alkyl, optionally substituted $C_{1-30}$ alkenyl, or optionally substituted $C_{1-30}$ alkynyl; optionally wherein one or more methylene units of $R^2$ are independently replaced with optionally substituted carbocyclylene, optionally substituted heterocyclylene, optionally substituted arylene, optionally substituted heteroarylene, N(R$^N$), O, S, C(O), C(O)N(R$^N$), NR$^N$C(O), —NR$^N$C(O)N(R$^N$), C(O)O, OC(O), OC(O)O, OC(O)N(R$^N$), NR$^N$C(O)O, C(O)S, SC(O), —C(=NR$^N$), C(=NR$^N$)N(R$^N$), NR$^N$C(=NR$^N$), NR$^N$C(=NR$^N$)N(R$^N$), C(S), C(S)N(R$^N$), NR$^N$C(S), NR$^N$C(S)N(R$^N$), S(O), OS(O), S(O)O, OS(O)O, OS(O)$_2$, S(O)$_2$O, OS(O)$_2$O, N(R$^N$)S(O), —S(O)N(R$^N$), N(R$^N$)S(O)N(R$^N$), OS(O)N(R$^N$), N(R$^N$)S(O)O, S(O)$_2$, N(R$^N$)S(O)$_2$, S(O)$_2$N(R$^N$), N(R$^N$)S(O)$_2$N(R$^N$), OS(O)$_2$N(R$^N$), or N(R$^N$)S(O)$_2$O;

each instance of R$^N$ is independently hydrogen, optionally substituted alkyl, or a nitrogen protecting group;

Ring B is optionally substituted carbocyclyl, optionally substituted heterocyclyl, optionally substituted aryl, or optionally substituted heteroaryl; and p is 1 or 2;

provided that the compound is not of the formula:

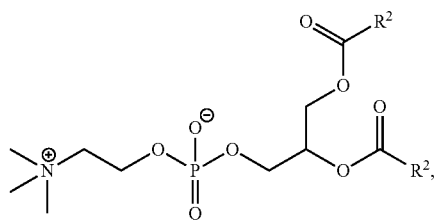

wherein each instance of R$^2$ is independently unsubstituted alkyl, unsubstituted alkenyl, or unsubstituted alkynyl.

Phospholipid Head Modifications

In certain embodiments, a phospholipid useful or potentially useful in the present invention comprises a modified phospholipid head (e.g., a modified choline group). In certain embodiments, a phospholipid with a modified head is DSPC, or analog thereof, with a modified quaternary amine. For example, in embodiments of Formula (IX), at least one of R$^1$ is not methyl. In certain embodiments, at least one of R$^1$ is not hydrogen or methyl. In certain embodiments, the compound of Formula (IX) is of one of the following formulae:

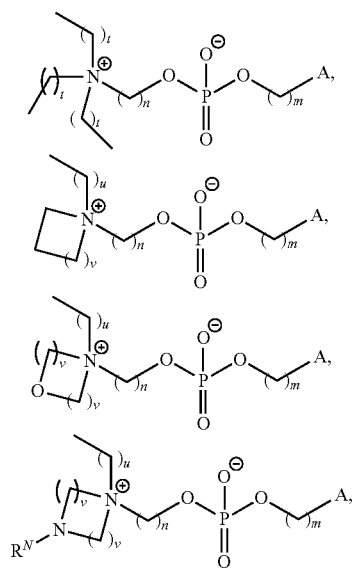

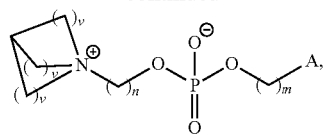

or a salt thereof, wherein:

each t is independently 1, 2, 3, 4, 5, 6, 7, 8, 9, or 10;

each u is independently 0, 1, 2, 3, 4, 5, 6, 7, 8, 9, or 10; and each v is independently 1, 2, or 3.

In certain embodiments, the compound of Formula (IX) is of one of the following formulae:

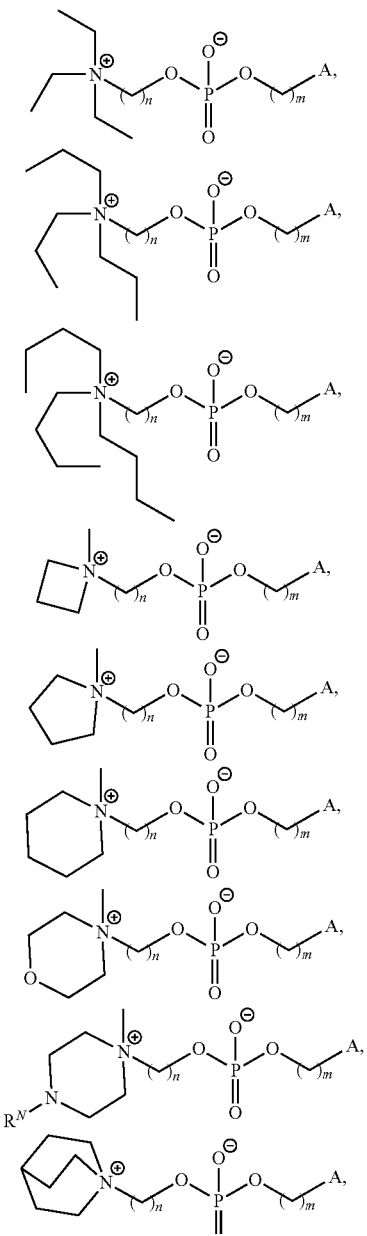

or a salt thereof.

In certain embodiments, a compound of Formula (IX) is one of the following:
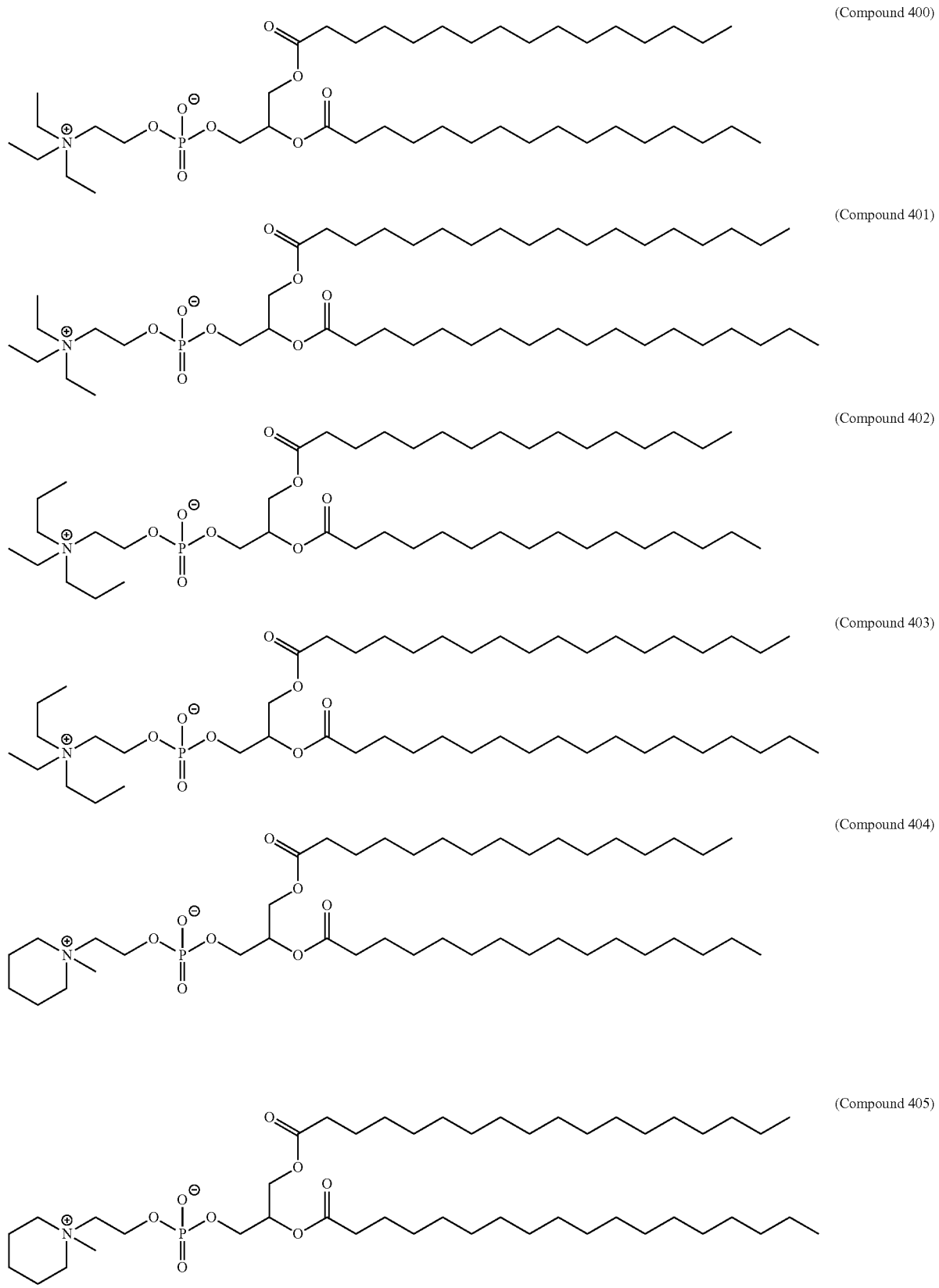
(Compound 400)
(Compound 401)
(Compound 402)
(Compound 403)
(Compound 404)
(Compound 405)

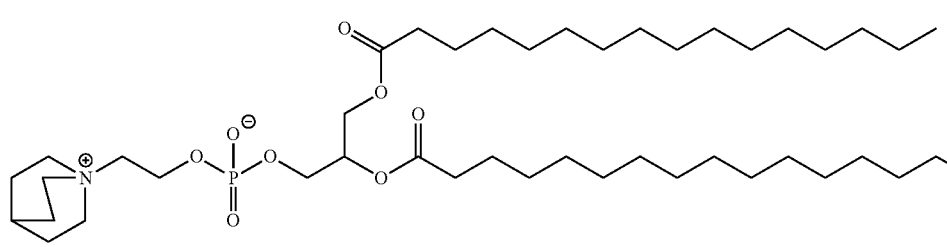
(Compound 406)

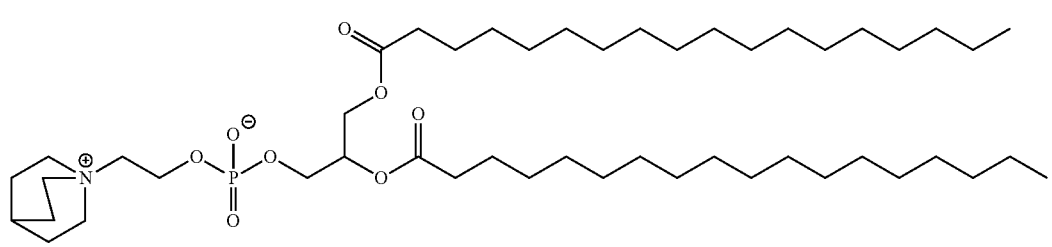
(Compound 407)

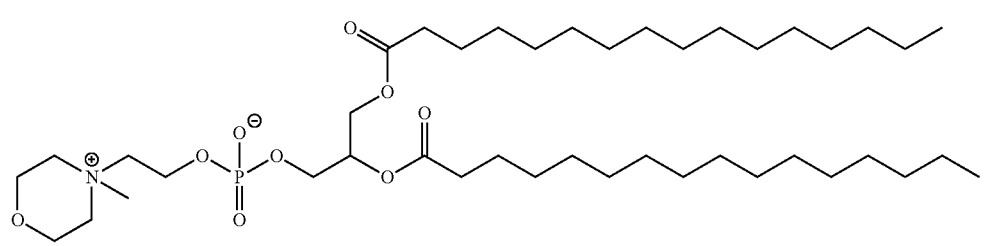
(Compound 408)

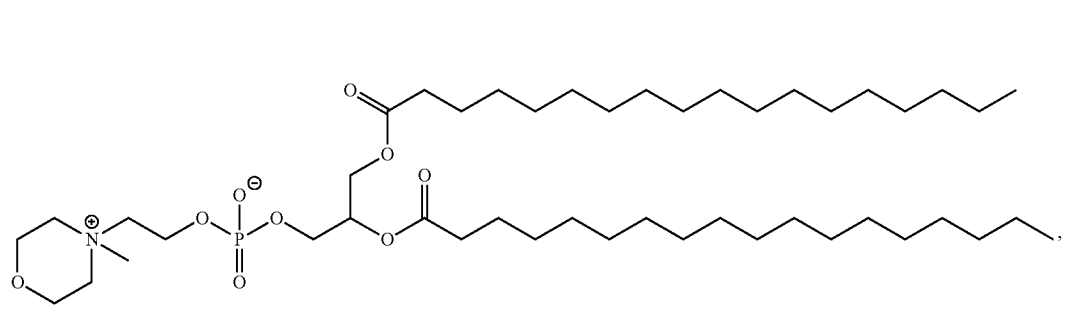
(Compound 409)

or a salt thereof.

In certain embodiments, a compound of Formula (IX) is of Formula (IX-a):

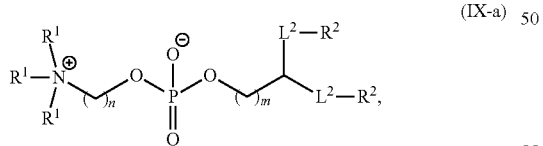
(IX-a)

or a salt thereof.

In certain embodiments, phospholipids useful or potentially useful in the present invention comprise a modified core. In certain embodiments, a phospholipid with a modified core described herein is DSPC, or analog thereof, with a modified core structure. For example, in certain embodiments of Formula (IX-a), group A is not of the following formula:

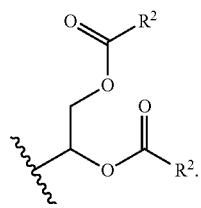

In certain embodiments, the compound of Formula (IX-a) is of one of the following formulae:

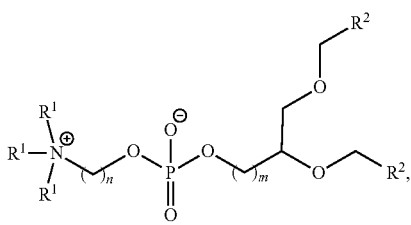

237
-continued
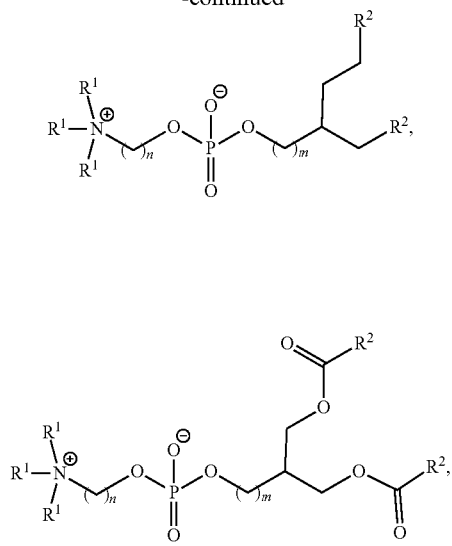
238
-continued
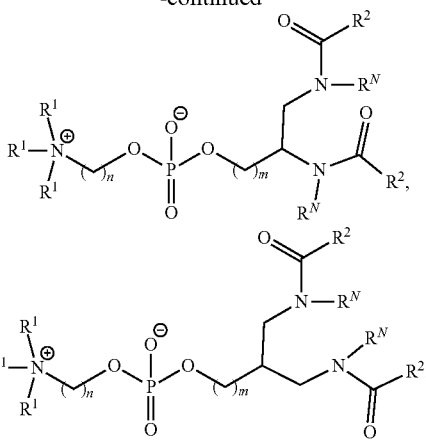
or a salt thereof.
In certain embodiments, a compound of Formula (IX) is one of the following:
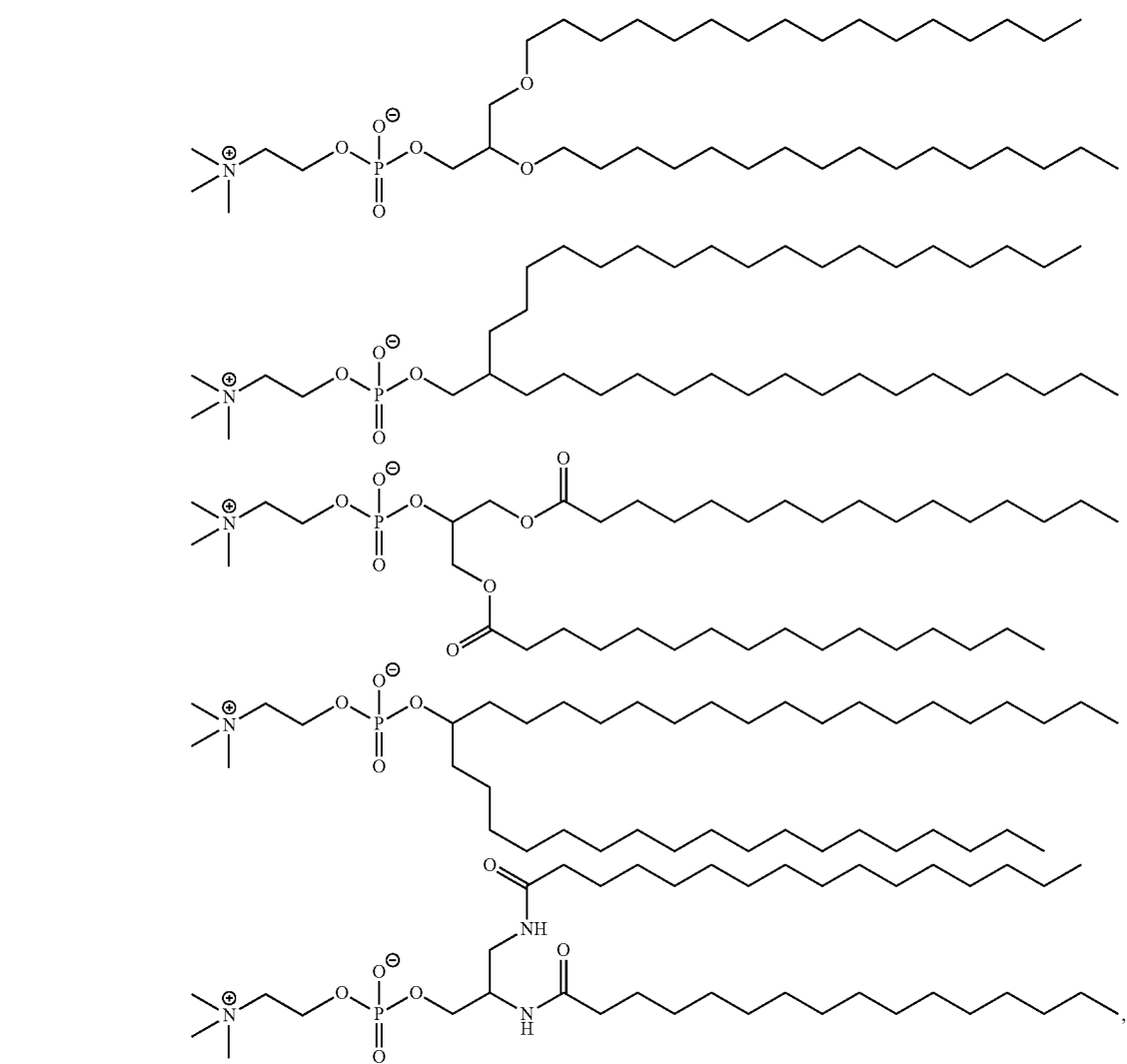
or salts thereof.

In certain embodiments, a phospholipid useful or potentially useful in the present invention comprises a cyclic moiety in place of the glyceride moiety. In certain embodiments, a phospholipid useful in the present invention is DSPC, or analog thereof, with a cyclic moiety in place of the glyceride moiety. In certain embodiments, the compound of Formula (IX) is of Formula (IX-b):

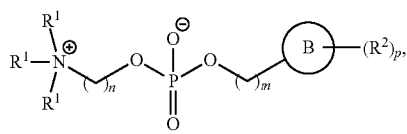
(IX-b)

or a salt thereof.

In certain embodiments, the compound of Formula (IX-b) is of Formula (IX-b-1):

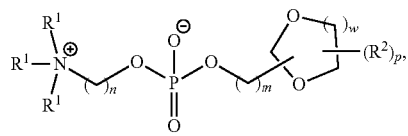
(IX-b-1)

or a salt thereof, wherein:

w is 0, 1, 2, or 3.

In certain embodiments, the compound of Formula (IX-b) is of Formula (IX-b-2):

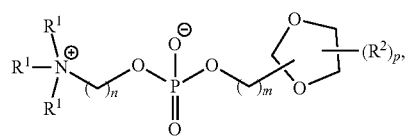
(IX-b-2)

or a salt thereof.

In certain embodiments, the compound of Formula (IX-b) is of Formula (IX-b-3):

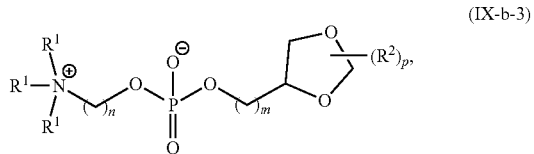
(IX-b-3)

or a salt thereof.

In certain embodiments, the compound of Formula (IX-b) is of Formula (IX-b-4):

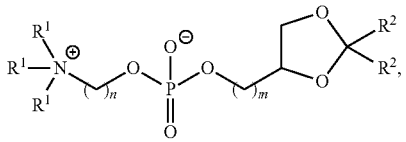
(IX-b-4)

or a salt thereof.

In certain embodiments, the compound of Formula (IX-b) is one of the following:

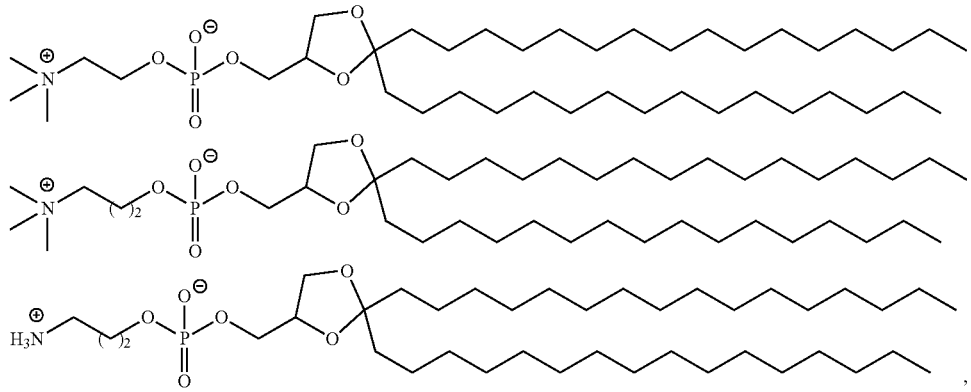

or salts thereof.

Phospholipid Tail Modifications

In certain embodiments, a phospholipid useful or potentially useful in the present invention comprises a modified tail. In certain embodiments, a phospholipid useful or potentially useful in the present invention is DSPC, or analog thereof, with a modified tail. As described herein, a "modified tail" may be a tail with shorter or longer aliphatic chains, aliphatic chains with branching introduced, aliphatic chains with substituents introduced, aliphatic chains wherein one or more methylenes are replaced by cyclic or heteroatom groups, or any combination thereof. For example, in certain embodiments, the compound of (IX) is of Formula (IX-a), or a salt thereof, wherein at least one instance of $R^2$ is each instance of $R^2$ is optionally substituted $C_{1-30}$ alkyl, wherein one or more methylene units of $R^2$ are independently replaced with optionally substituted carbocyclylene, optionally substituted heterocyclylene, optionally substituted arylene, optionally substituted heteroarylene, $N(R^N)$, —O, S, C(O), C(O)N($R^N$), $NR^N$C(O), $NR^N$C(O)N($R^N$), C(O)O, OC(O), OC(O)O, OC(O)N($R^N$), $NR^N$C(O)O, C(O)S, SC(O), C(=$NR^N$), C(=$NR^N$)N($R^N$), $NR^N$C(=$NR^N$), $NR^N$C(=$NR^N$)N($R^N$), —C(S), C(S)N($R^N$), $NR^N$C(S), $NR^N$C(S)N($R^N$), S(O), OS(O), S(O)O, OS(O)O, OS(O)$_2$, —S(O)$_2$O, OS(O)$_2$O, N($R^N$)S(O), S(O)N($R^N$), N($R^N$)S(O)N($R^N$), OS(O)N($R^N$), N($R^N$)S(O)O, —S(O)$_2$, N($R^N$)S(O)$_2$, S(O)$_2$N($R^N$), N($R^N$)S(O)$_2$N($R^N$), OS(O)$_2$N($R^N$), or N($R^N$)S(O)$_2$O.

In certain embodiments, the compound of Formula (IX) is of Formula (IX-c):

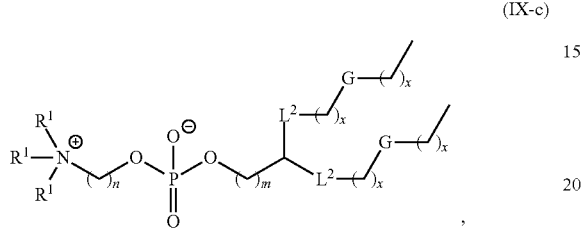

(IX-c)

or a salt thereof, wherein:

each x is independently an integer between 0-30, inclusive; and each instance is G is independently selected from the group consisting of optionally substituted carbocyclylene, optionally substituted heterocyclylene, optionally substituted arylene, optionally substituted heteroarylene, N($R^N$), O, S, C(O), C(O)N($R^N$), $NR^N$C(O), —$NR^N$C(O)N($R^N$), C(O)O, OC(O), OC(O)O, OC(O)N($R^N$), $NR^N$C(O)O, C(O)S, SC(O), —C(=$NR^N$), C(=$NR^N$)N($R^N$), $NR^N$C(=$NR^N$), $NR^N$C(=$NR^N$)N($R^N$), C(S), C(S)N($R^N$), $NR^N$C(S), $NR^N$C(S)N($R^N$), S(O), OS(O), S(O)O, OS(O)O, OS(O)$_2$, S(O)$_2$O, OS(O)$_2$O, N($R^N$)S(O), —S(O)N($R^N$), N($R^N$)S(O)N($R^N$), OS(O)N($R^N$), N($R^N$)S(O)O, S(O)$_2$, N($R^N$)S(O)$_2$, S(O)$_2$N($R^N$), N($R^N$)S(O)$_2$N($R^N$), OS(O)$_2$N($R^N$), or N($R^N$)S(O)$_2$O. Each possibility represents a separate embodiment of the present invention.

In certain embodiments, the compound of Formula (IX-c) is of Formula (IX-c-1):

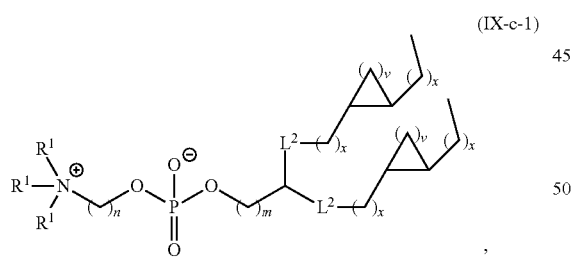

(IX-c-1)

or salt thereof, wherein:

each instance of v is independently 1, 2, or 3.

In certain embodiments, the compound of Formula (IX-c) is of Formula (IX-c-2):

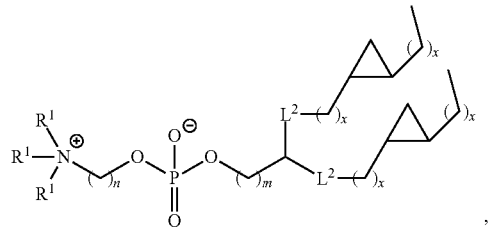

(IX-c-2)

or a salt thereof.

In certain embodiments, the compound of Formula (IX-c) is of the following formula:

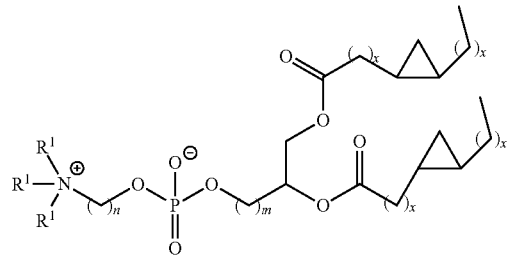

or a salt thereof.

In certain embodiments, the compound of Formula (IX-c) is the following:

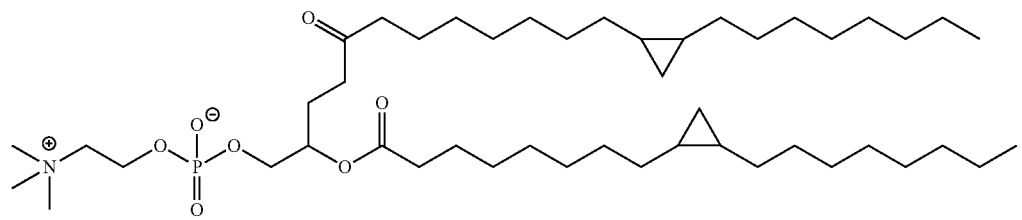

or a salt thereof.

In certain embodiments, the compound of Formula (IX-c) is of Formula (IX-c-3):

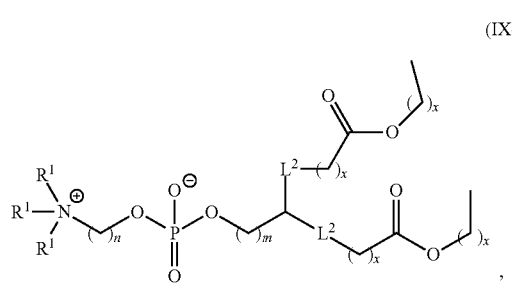

(IX-c-3)

or a salt thereof.

In certain embodiments, the compound of Formula (IX-c) is of the following formulae:

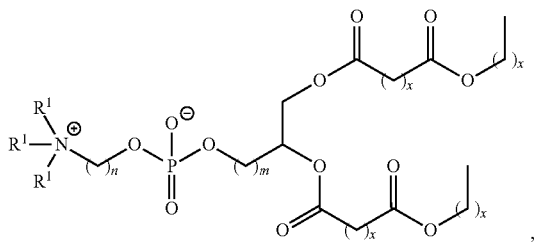

or a salt thereof.

In certain embodiments, the compound of Formula (IX-c) is the following:

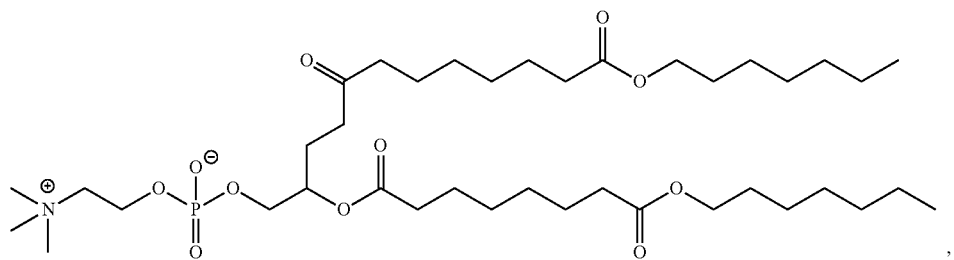 [SMILES: CCCCCCCOC(=O)CCCCCCC(=O)CCC(COP(=O)([O-])OCC[N+](C)(C)C)OC(=O)CCCCCCC(=O)OCCCCCCC]

or a salt thereof.

In certain embodiments, a phospholipid useful or potentially useful in the present invention comprises a modified phosphocholine moiety, wherein the alkyl chain linking the quaternary amine to the phosphoryl group is not ethylene (e.g., n is not 2). Therefore, in certain embodiments, a phospholipid useful or potentially useful in the present invention is a compound of Formula (IX), wherein n is 1, 3, 4, 5, 6, 7, 8, 9, or 10. For example, in certain embodiments, a compound of Formula (IX) is of one of the following formulae:

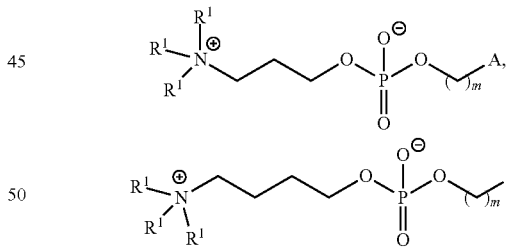

or a salt thereof.

In certain embodiments, a compound of Formula (IX) is one of the following:

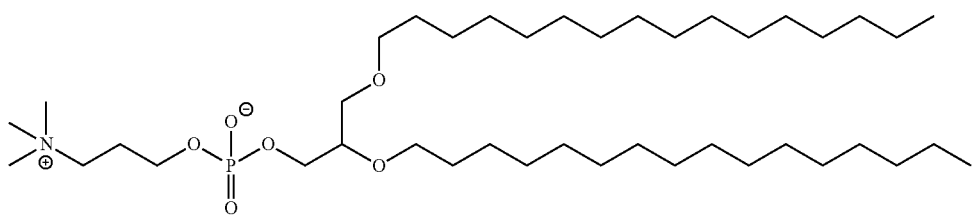

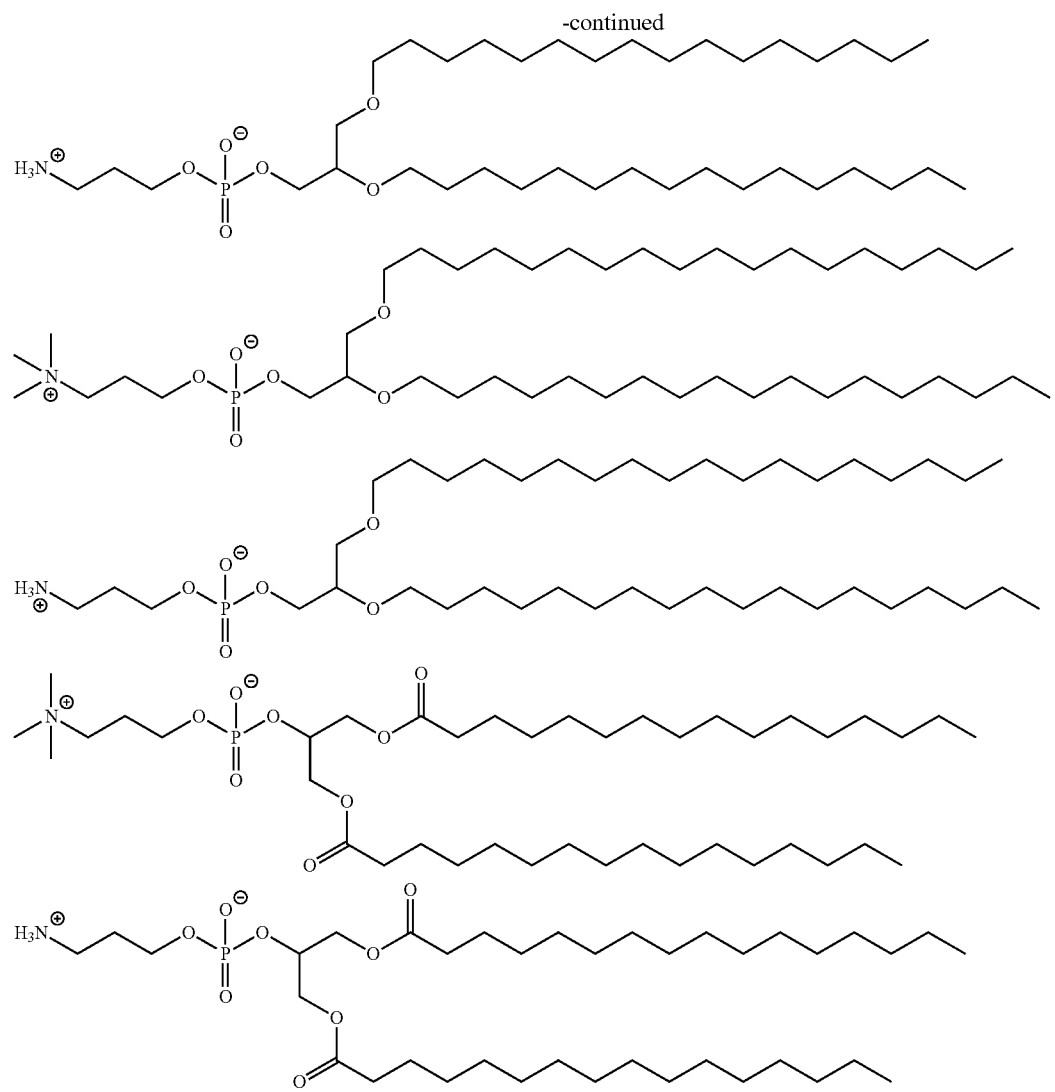
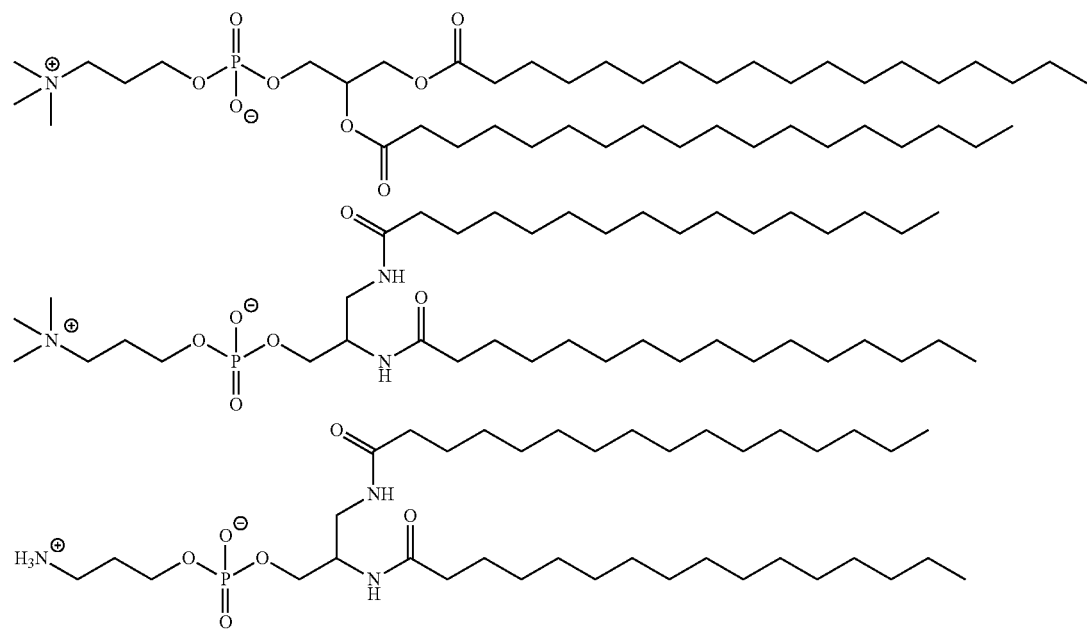
(Compound 411)

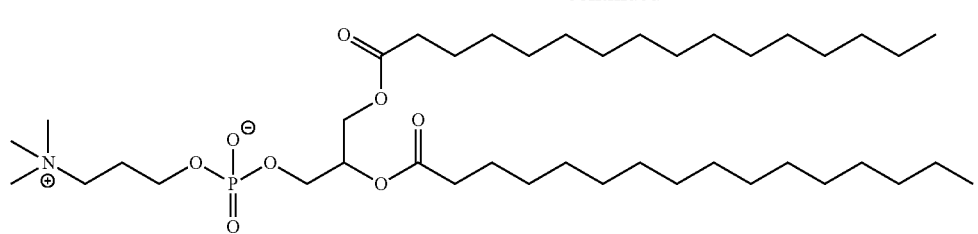
(Compound 412)
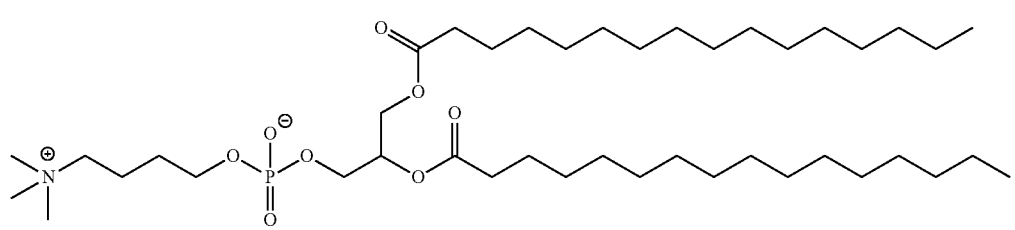
(Compound 413)
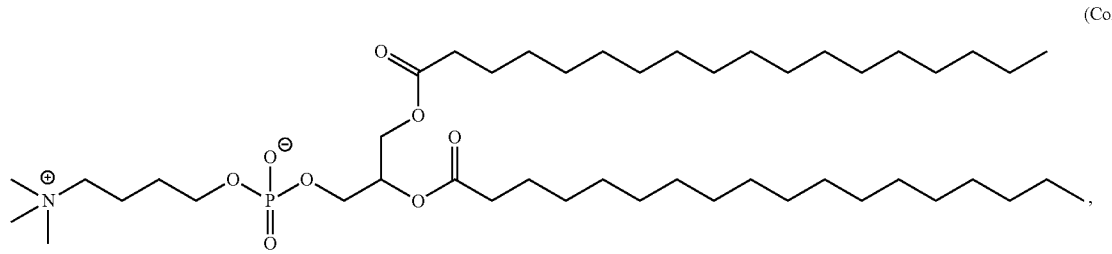
(Compound 414)
or salts thereof.
Alternative Lipids
In certain embodiments, an alternative lipid is used in place of a phospholipid of the invention. Non-limiting examples of such alternative lipids include the following:
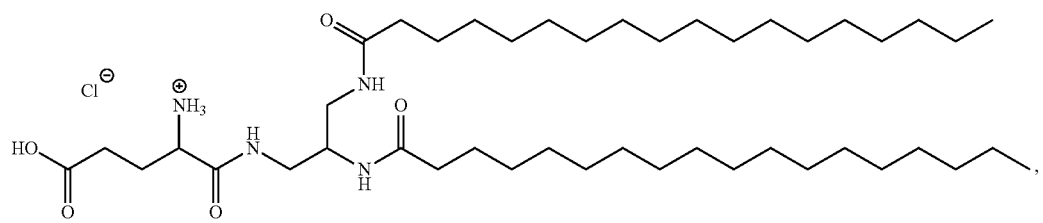
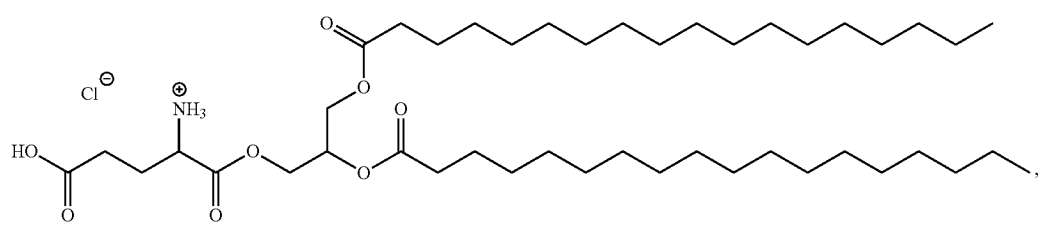
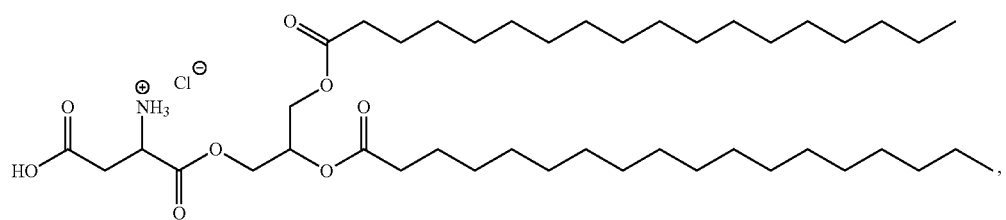

-continued

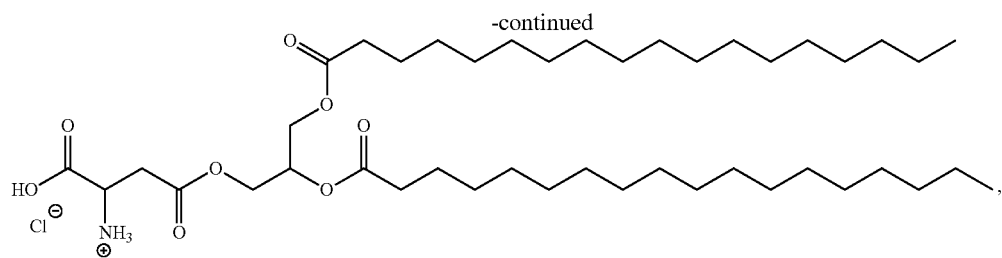

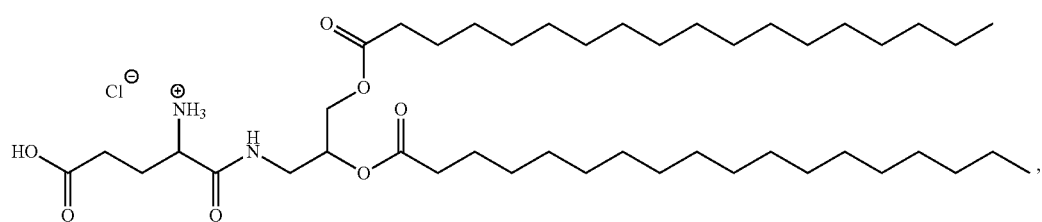

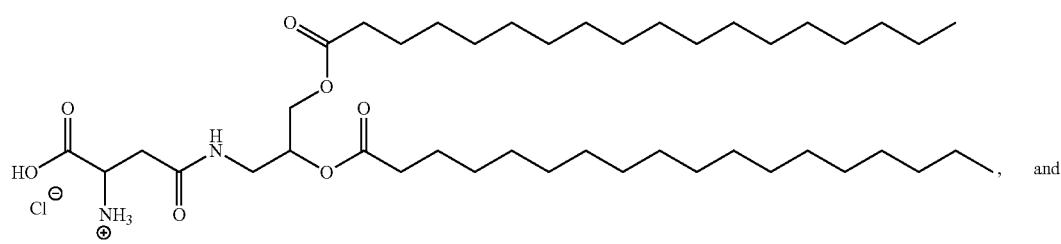, and

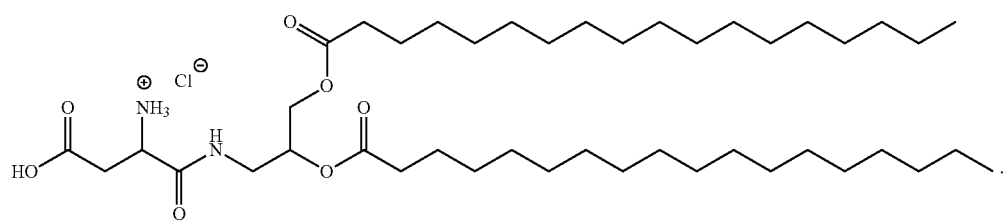.

(ii) Structural Lipids

The lipid composition of a pharmaceutical composition disclosed herein can comprise one or more structural lipids. As used herein, the term "structural lipid" refers to sterols and also to lipids containing sterol moieties.

Incorporation of structural lipids in the lipid nanoparticle may help mitigate aggregation of other lipids in the particle. Structural lipids can be selected from the group including but not limited to, cholesterol, fecosterol, sitosterol, ergosterol, campesterol, stigmasterol, brassicasterol, tomatidine, tomatine, ursolic acid, alpha-tocopherol, hopanoids, phytosterols, steroids, and mixtures thereof. In some embodiments, the structural lipid is a sterol. As defined herein, "sterols" are a subgroup of steroids consisting of steroid alcohols. In certain embodiments, the structural lipid is a steroid. In certain embodiments, the structural lipid is cholesterol. In certain embodiments, the structural lipid is an analog of cholesterol. In certain embodiments, the structural lipid is alpha-tocopherol. Examples of structural lipids include, but are not limited to, the following:

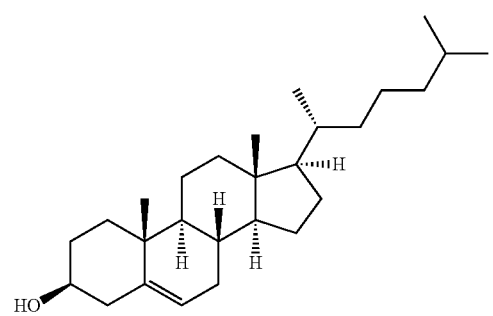,

-continued

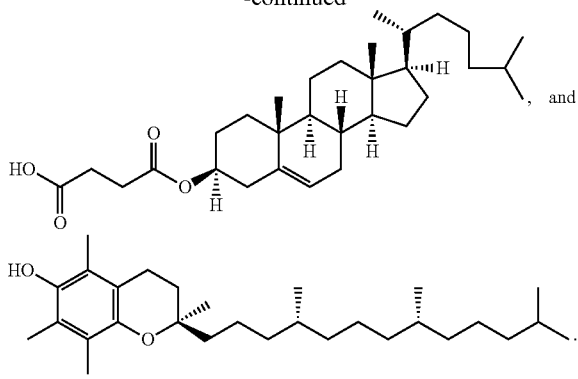

In one embodiment, the amount of the structural lipid (e.g., an sterol such as cholesterol) in the lipid composition of a pharmaceutical composition disclosed herein ranges from about 20 mol % to about 60 mol %, from about 25 mol % to about 55 mol %, from about 30 mol % to about 50 mol %, or from about 35 mol % to about 45 mol %.

In one embodiment, the amount of the structural lipid (e.g., an sterol such as cholesterol) in the lipid composition disclosed herein ranges from about 25 mol % to about 30 mol %, from about 30 mol % to about 35 mol %, or from about 35 mol % to about 40 mol %.

In one embodiment, the amount of the structural lipid (e.g., a sterol such as cholesterol) in the lipid composition disclosed herein is about 24 mol %, about 29 mol %, about 34 mol %, or about 39 mol %.

In some embodiments, the amount of the structural lipid (e.g., an sterol such as cholesterol) in the lipid composition disclosed herein is at least about 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 mol %.

(iii) Polyethylene Glycol (PEG)-Lipids

The lipid composition of a pharmaceutical composition disclosed herein can comprise one or more a polyethylene glycol (PEG) lipid.

As used herein, the term "PEG-lipid" refers to polyethylene glycol (PEG)-modified lipids. Non-limiting examples of PEG-lipids include PEG-modified phosphatidylethanolamine and phosphatidic acid, PEG-ceramide conjugates (e.g., PEG-CerC14 or PEG-CerC20), PEG-modified dialkylamines and PEG-modified 1,2-diacyloxypropan-3-amines. Such lipids are also referred to as PEGylated lipids. For example, a PEG lipid can be PEG-c-DOMG, PEG-DMG, PEG-DLPE, PEG-DMPE, PEG-DPPC, or a PEG-DSPE lipid.

In some embodiments, the PEG-lipid includes, but not limited to 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DSG), PEG-dipalmetoleyl, PEG-dioleyl, PEG-distearyl, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA).

In one embodiment, the PEG-lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the lipid moiety of the PEG-lipids includes those having lengths of from about $C_{14}$ to about $C_{22}$, preferably from about $C_{14}$ to about $C_{16}$. In some embodiments, a PEG moiety, for example an mPEG-NH$_2$, has a size of about 1000, 2000, 5000, 10,000, 15,000 or 20,000 daltons. In one embodiment, the PEG-lipid is PEG$_{2k}$-DMG.

In one embodiment, the lipid nanoparticles described herein can comprise a PEG lipid which is a non-diffusible PEG. Non-limiting examples of non-diffusible PEGs include PEG-DSG and PEG-DSPE.

PEG-lipids are known in the art, such as those described in U.S. Pat. No. 8,158,601 and International Publ. No. WO 2015/130584 A2, which are incorporated herein by reference in their entirety.

In general, some of the other lipid components (e.g., PEG lipids) of various formulae, described herein may be synthesized as described International Patent Application No. PCT/US2016/000129, filed Dec. 10, 2016, entitled "Compositions and Methods for Delivery of Therapeutic Agents," which is incorporated by reference in its entirety.

The lipid component of a lipid nanoparticle composition may include one or more molecules comprising polyethylene glycol, such as PEG or PEG-modified lipids. Such species may be alternately referred to as PEGylated lipids. A PEG lipid is a lipid modified with polyethylene glycol. A PEG lipid may be selected from the non-limiting group including PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, a PEG lipid may be PEG-c-DOMG, PEG-DMG, PEG-DLPE, PEG-DMPE, PEG-DPPC, or a PEG-DSPE lipid.

In some embodiments the PEG-modified lipids are a modified form of PEG DMG. PEG-DMG has the following structure:

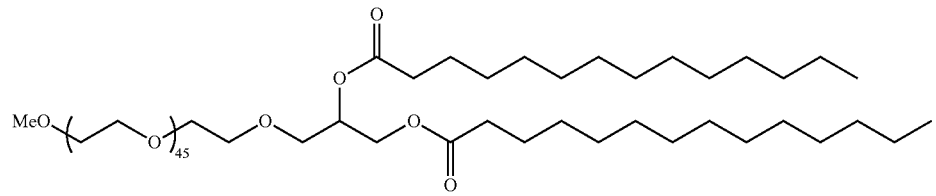

In one embodiment, PEG lipids useful in the present invention can be PEGylated lipids described in International Publication No. WO2012099755, the contents of which is herein incorporated by reference in its entirety. Any of these exemplary PEG lipids described herein may be modified to comprise a hydroxyl group on the PEG chain. In certain embodiments, the PEG lipid is a PEG-OH lipid. As generally defined herein, a "PEG-OH lipid" (also referred to herein as "hydroxy-PEGylated lipid") is a PEGylated lipid having one or more hydroxyl (—OH) groups on the lipid. In certain embodiments, the PEG-OH lipid includes one or more hydroxyl groups on the PEG chain. In certain embodiments, a PEG-OH or hydroxy-PEGylated lipid comprises an —OH group at the terminus of the PEG chain. Each possibility represents a separate embodiment of the present invention.

In certain embodiments, a PEG lipid useful in the present invention is a compound of Formula (VII). Provided herein are compounds of Formula (VII):

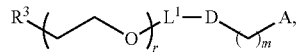
(VII)

or salts thereof, wherein:
$R^3$ is —$OR^O$;
$R^O$ is hydrogen, optionally substituted alkyl, or an oxygen protecting group;
r is an integer between 1 and 100, inclusive;
$L^1$ is optionally substituted $C_{1-10}$ alkylene, wherein at least one methylene of the optionally substituted $C_{1-10}$ alkylene is independently replaced with optionally substituted carbocyclylene, optionally substituted heterocyclylene, optionally substituted arylene, optionally substituted heteroarylene, O, N($R^N$), S, C(O), C(O)N($R^N$), $NR^N$C(O), C(O)O, —OC(O), OC(O)O, OC(O)N($R^N$), $NR^N$C(O)O, or $NR^N$C(O)N($R^N$);
D is a moiety obtained by click chemistry or a moiety cleavable under physiological conditions;
m is 0, 1, 2, 3, 4, 5, 6, 7, 8, 9, or 10;
A is of the formula:

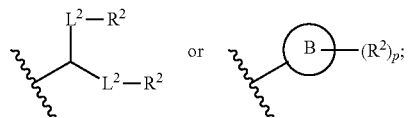

each instance of $L^2$ is independently a bond or optionally substituted $C_{1-6}$ alkylene, wherein one methylene unit of the optionally substituted $C_{1-6}$ alkylene is optionally replaced with O, N($R^N$), S, C(O), C(O)N($R^N$), $NR^N$C(O), C(O)O, OC(O), OC(O)O, OC(O)N($R^N$), —$NR^N$C(O)O, or $NR^N$C(O)N($R^N$);
each instance of $R^2$ is independently optionally substituted $C_{1-30}$ alkyl, optionally substituted $C_{1-30}$ alkenyl, or optionally substituted $C_{1-30}$ alkynyl; optionally wherein one or more methylene units of $R^2$ are independently replaced with optionally substituted carbocyclylene, optionally substituted heterocyclylene, optionally substituted arylene, optionally substituted heteroarylene, N($R^N$), O, S, C(O), C(O)N($R^N$), $NR^N$C(O), —$NR^N$C(O)N($R^N$), C(O)O, OC(O), OC(O)O, OC(O)N($R^N$), $NR^N$C(O)O, C(O)S, SC(O), —C(=$NR^N$), C(=$NR^N$)N($R^N$), $NR^N$C(=$NR^N$), $NR^N$C(=$NR^N$)N($R^N$), C(S), C(S)N($R^N$), $NR^N$C(S), $NR^N$C(S)N($R^N$), S(O), OS(O), S(O)O, OS(O)O, OS(O)$_2$, S(O)$_2$O, OS(O)$_2$O, N($R^N$)S(O), —S(O)N($R^N$), N($R^N$)S(O)N($R^N$), OS(O)N($R^N$), N($R^N$)S(O)O, S(O)$_2$, N($R^N$)S(O)$_2$, S(O)$_2$N($R^N$), N($R^N$)S(O)$_2$N($R^N$), OS(O)$_2$N($R^N$), or N($R^N$)S(O)$_2$O;
each instance of $R^N$ is independently hydrogen, optionally substituted alkyl, or a nitrogen protecting group;

Ring B is optionally substituted carbocyclyl, optionally substituted heterocyclyl, optionally substituted aryl, or optionally substituted heteroaryl; and
p is 1 or 2.

In certain embodiments, the compound of Formula (VII) is a PEG-OH lipid (i.e., $R^3$ is —$OR^O$, and $R^O$ is hydrogen). In certain embodiments, the compound of Formula (VII) is of Formula (VII-OH):

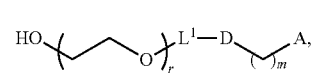
(VII-OH)

or a salt thereof.

In certain embodiments, D is a moiety obtained by click chemistry (e.g., triazole). In certain embodiments, the compound of Formula (VII) is of Formula (VII-a-1) or (VII-a-2):

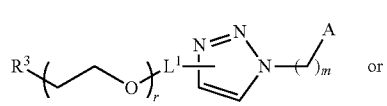
(VII-a-1)

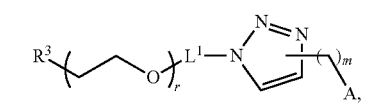
(VII-a-2)

or a salt thereof.

In certain embodiments, the compound of Formula (VII) is of one of the following formulae:

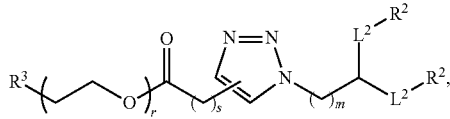

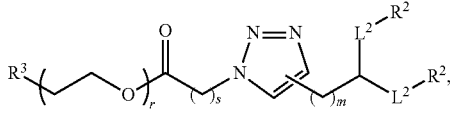

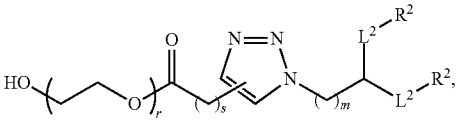

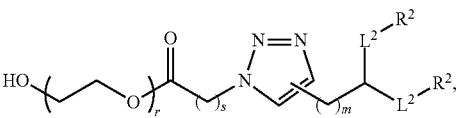

or a salt thereof, wherein
s is 0, 1, 2, 3, 4, 5, 6, 7, 8, 9, or 10.

In certain embodiments, the compound of Formula (VII) is of one of the following formulae:

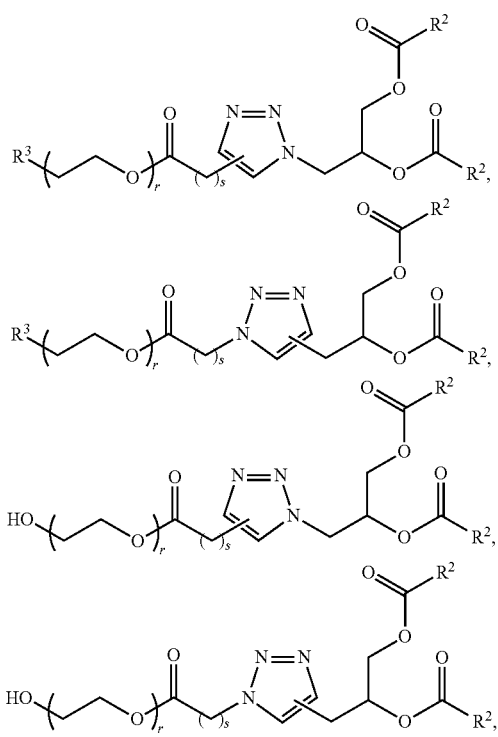
or a salt thereof.
In certain embodiments, a compound of Formula (VII) is of one of the following formulae:
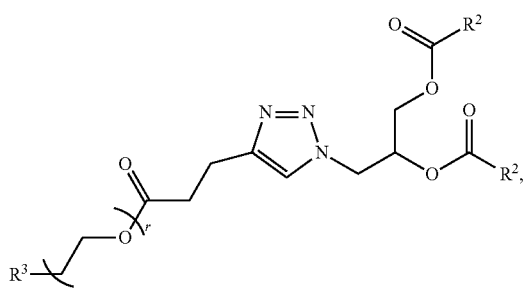
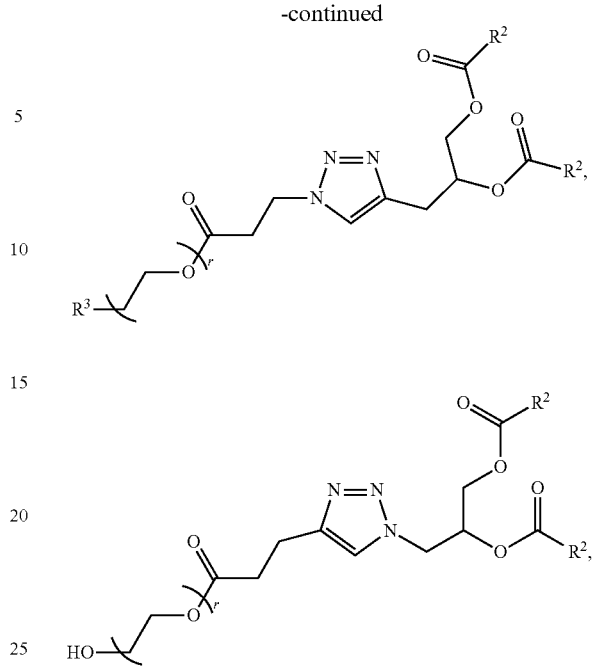
or a salt thereof.
In certain embodiments, a compound of Formula (VII) is of one of the following formulae:
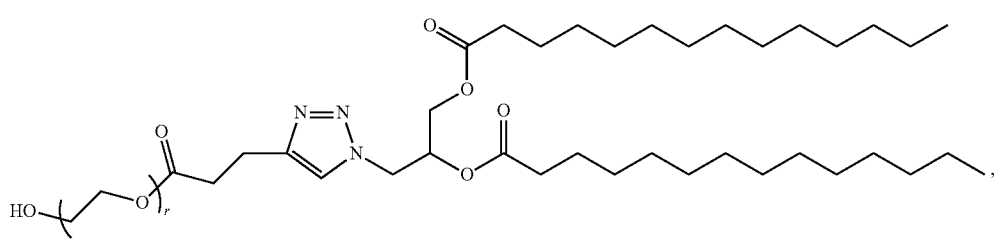
(Compound 415)
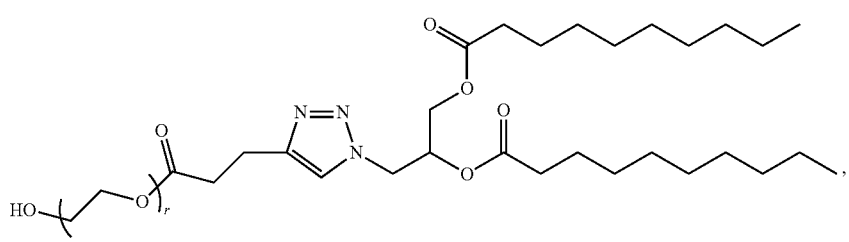
(Compound 416)

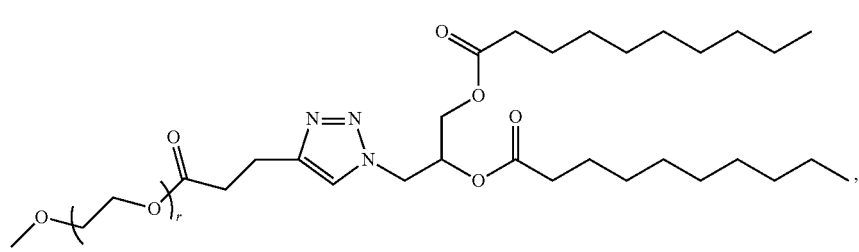
(Compound 417)

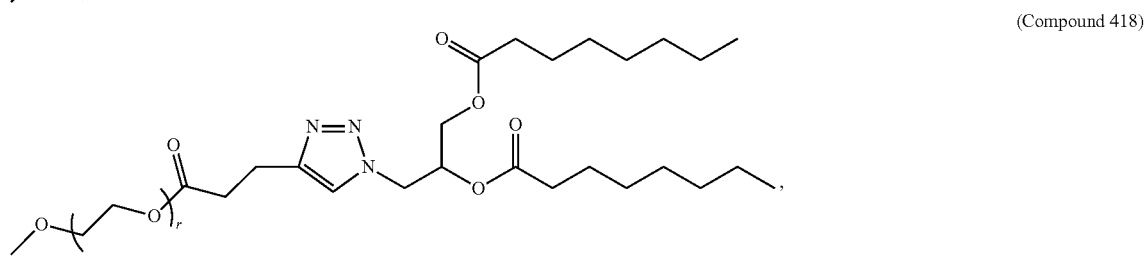
(Compound 418)

or a salt thereof.

In certain embodiments, D is a moiety cleavable under physiological conditions (e.g., ester, amide, carbonate, carbamate, urea). In certain embodiments, a compound of Formula (VII) is of Formula (VII-b-1) or (VII-b-2):

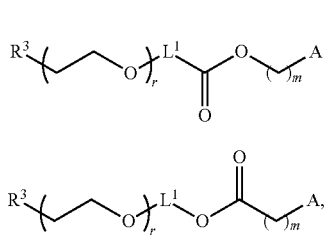

or a salt thereof.

In certain embodiments, a compound of Formula (VII) is of Formula (VII-b-1-OH) or (VII-b-2-OH):

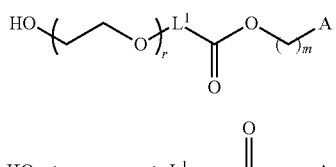

or a salt thereof.

In certain embodiments, the compound of Formula (VII) is of one of the following formulae:

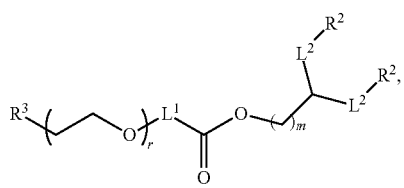

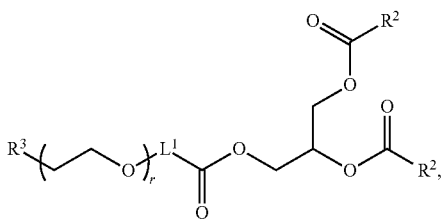

or a salt thereof.

In certain embodiments, a compound of Formula (VII) is of one of the following formulae:

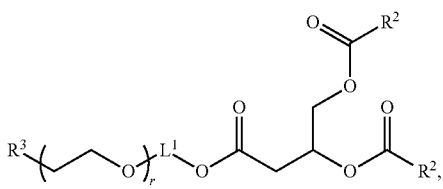

-continued

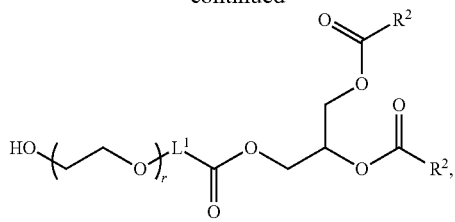

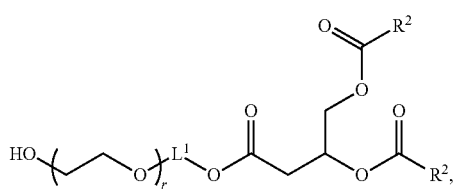

or a salt thereof.

-continued

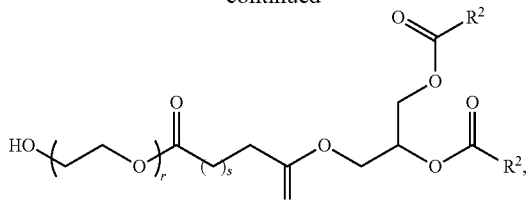

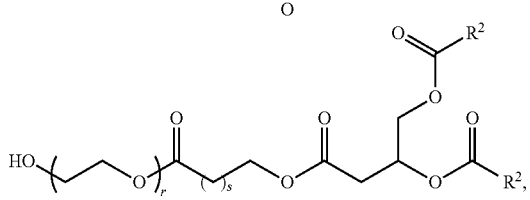

or a salt thereof.

In certain embodiments, a compound of Formula (VII) is of one of the following formulae:

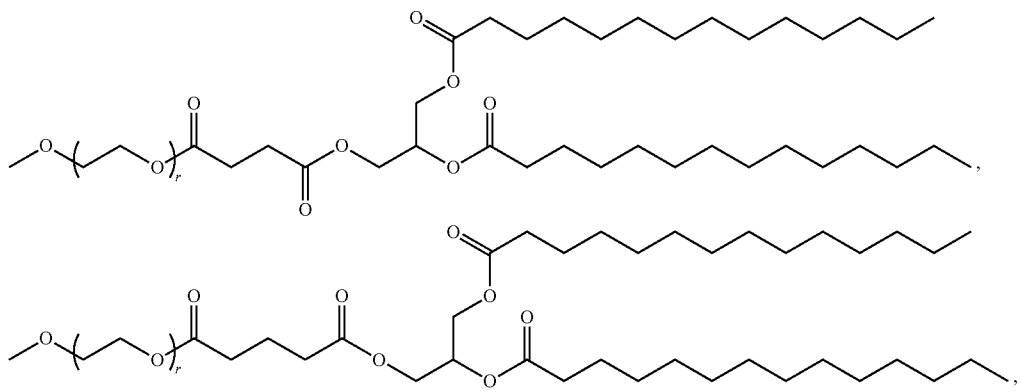

or salts thereof.

In certain embodiments, a PEG lipid useful in the present invention is a PEGylated fatty acid. In certain embodiments, a PEG lipid useful in the present invention is a compound of Formula (VIII). Provided herein are compounds of Formula (VIII):

(VIII)

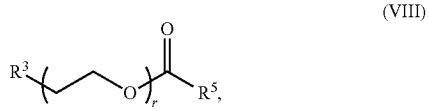

or a salts thereof, wherein:

$R^3$ is —$OR^O$;

$R^O$ is hydrogen, optionally substituted alkyl or an oxygen protecting group;

r is an integer between 1 and 100, inclusive;

$R^5$ is optionally substituted $C_{10-40}$ alkyl, optionally substituted $C_{10-40}$ alkenyl, or optionally substituted $C_{10-40}$ alkynyl; and optionally one or more methylene groups of $R^5$ are replaced with optionally substituted carbocyclylene, optionally substituted heterocyclylene, optionally substituted arylene, optionally substituted heteroarylene, N($R^N$), O, S, C(O), —C(O)N($R^N$), $NR^N$C(O), $NR^N$C(O)N($R^N$), C(O)O, OC(O), OC(O)O, OC(O)N($R^N$), —$NR^N$C(O)O, C(O)S, SC(O), C(=$NR^N$), C(=$NR^N$)N($R^N$), $NR^N$C(=$NR^N$), In certain embodiments, a compound of Formula (VII) is of one of the following formulae:

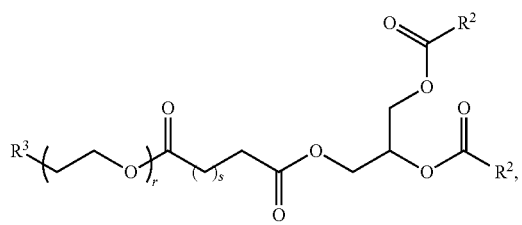

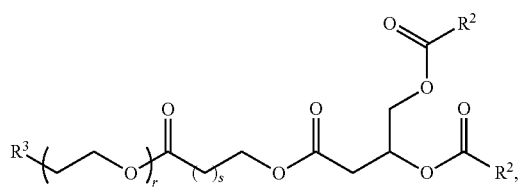

NR$^N$C(=NR$^N$)N(R$^N$), —C(S), C(S)N(R$^N$), NR$^N$C(S), NR$^N$C(S)N(R$^N$), S(O), OS(O), S(O)O, OS(O)O, OS(O)$_2$, —S(O)$_2$O, OS(O)$_2$O, N(R$^N$)S(O), S(O)N(R$^N$), N(R$^N$)S(O)N(R$^N$), OS(O)N(R$^N$), N(R$^N$)S(O)O, —S(O)$_2$, N(R$^N$)S(O)$_2$, S(O)$_2$N(R$^N$), N(R$^N$)S(O)$_2$N(R$^N$), OS(O)$_2$N(R$^N$), or N(R$^N$)S(O)$_2$O; and each instance of R$^N$ is independently hydrogen, optionally substituted alkyl, or a nitrogen protecting group.

In certain embodiments, the compound of Formula (VIII) is of Formula (VIII-OH):

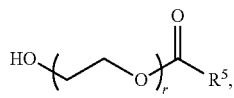
(VIII-OH)

or a salt thereof. In some embodiments, r is 45.

In certain embodiments, a compound of Formula (VIII) is of one of the following formulae:

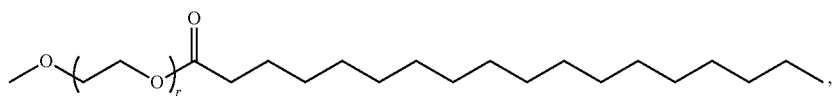
(Compound 419)

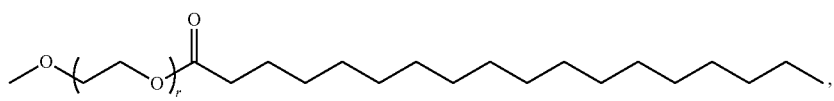
(Compound 420)

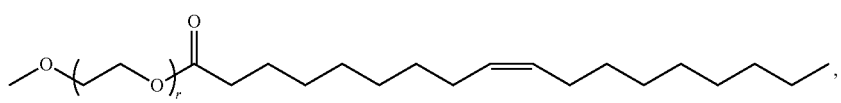
(Compound 421)

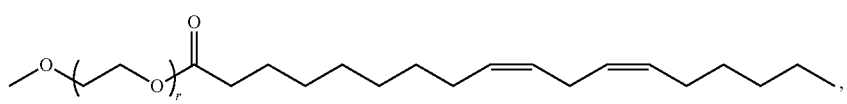
(Compound 422)

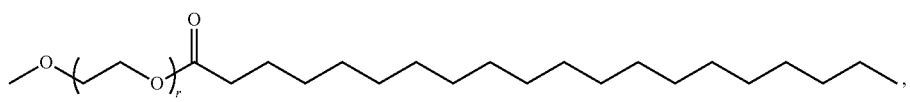
(Compound 423)

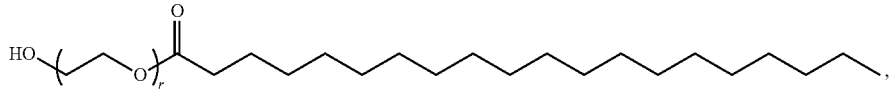
(Compound 424)

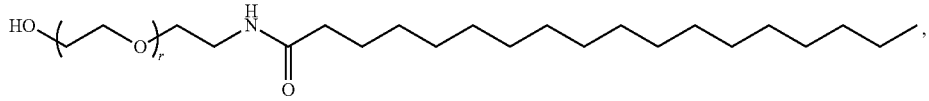
(Compound 425)

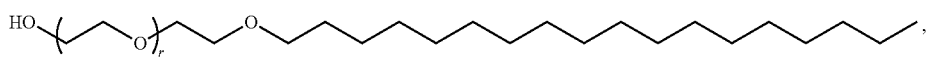
(Compound 426)

or a salt thereof. In some embodiments, r is 45.

In yet other embodiments the compound of Formula (VIII) is:

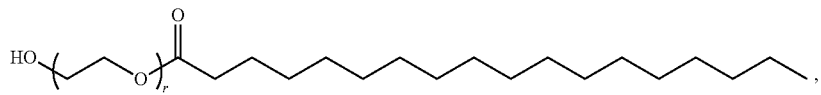
(Compound 427)

or a salt thereof.

In one embodiment, the compound of Formula (VIII) is

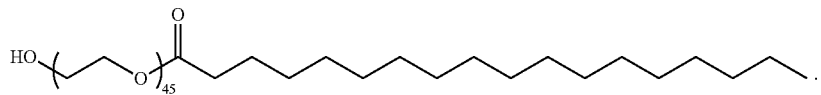
(Compound 428)

In one embodiment, the amount of PEG-lipid in the lipid composition of a pharmaceutical composition disclosed herein ranges from about 0.1 mol % to about 5 mol %, from about 0.5 mol % to about 5 mol %, from about 1 mol % to about 5 mol %, from about 1.5 mol % to about 5 mol %, from about 2 mol % to about 5 mol % mol %, from about 0.1 mol % to about 4 mol %, from about 0.5 mol % to about 4 mol %, from about 1 mol % to about 4 mol %, from about 1.5 mol % to about 4 mol %, from about 2 mol % to about 4 mol %, from about 0.1 mol % to about 3 mol %, from about 0.5 mol % to about 3 mol %, from about 1 mol % to about 3 mol %, from about 1.5 mol % to about 3 mol %, from about 2 mol % to about 3 mol %, from about 0.1 mol % to about 2 mol %, from about 0.5 mol % to about 2 mol %, from about 1 mol % to about 2 mol %, from about 1.5 mol % to about 2 mol %, from about 0.1 mol % to about 1.5 mol %, from about 0.5 mol % to about 1.5 mol %, or from about 1 mol % to about 1.5 mol %.

In one embodiment, the amount of PEG-lipid in the lipid composition disclosed herein is about 2 mol %. In one embodiment, the amount of PEG-lipid in the lipid composition disclosed herein is about 1.5 mol %.

In one embodiment, the amount of PEG-lipid in the lipid composition disclosed herein is at least about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, or 5 mol %.

In some aspects, the lipid composition of the pharmaceutical compositions disclosed herein does not comprise a PEG-lipid.

(iv) Other Ionizable Amino Lipids

The lipid composition of the pharmaceutical composition disclosed herein can comprise one or more ionizable amino lipids in addition to a lipid according to Formula (I), (III), (IV), (V), or (VI).

Ionizable lipids can be selected from the non-limiting group consisting of
3-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLin-DMA),
2,2-dilinoleyl-4-dimethylaminomethyl-[1,3]-dioxolane (DLin-K-DMA),
heptatriaconta-6,9,28,31-tetraen-19-yl 4-(dimethylamino)butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
(13Z,16SZ)—N,N-dimethyl-3-nonydocosa-13-16-dien-1-amine (L608),
2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and
(2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)). In addition to these, an ionizable amino lipid can also be a lipid including a cyclic amine group.

Ionizable lipids can also be the compounds disclosed in International Publication No. WO 2017/075531 A1, hereby incorporated by reference in its entirety. For example, the ionizable amino lipids include, but not limited to:

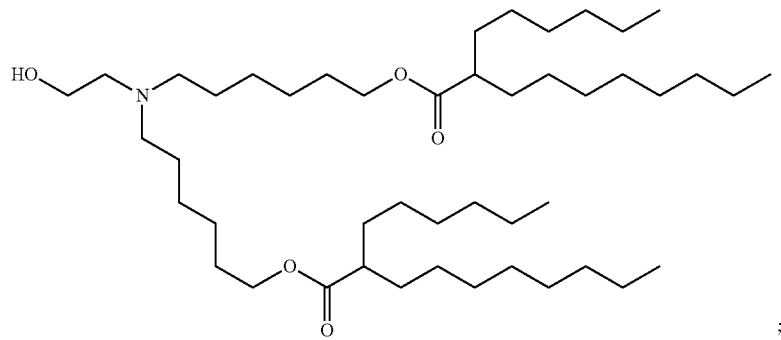

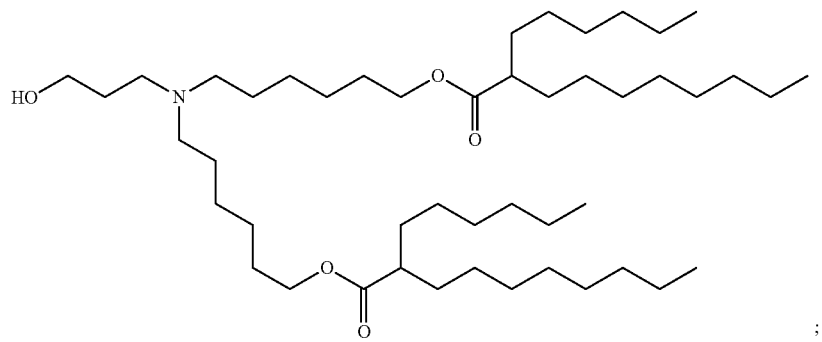

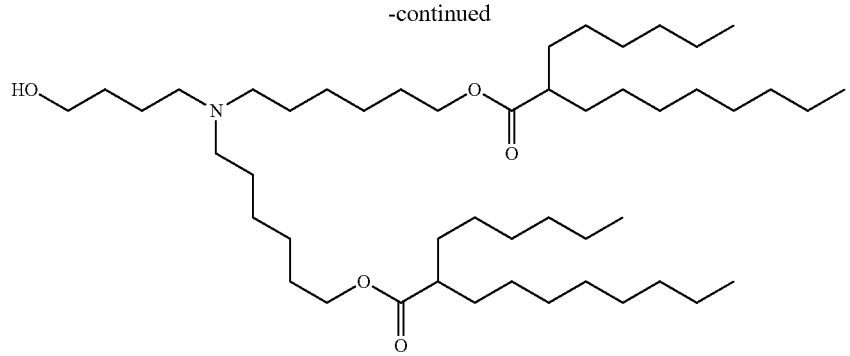
and any combination thereof.
Ionizable lipids can also be the compounds disclosed in International Publication No. WO 2015/199952 A1, hereby incorporated by reference in its entirety. For example, the ionizable amino lipids include, but not limited to:
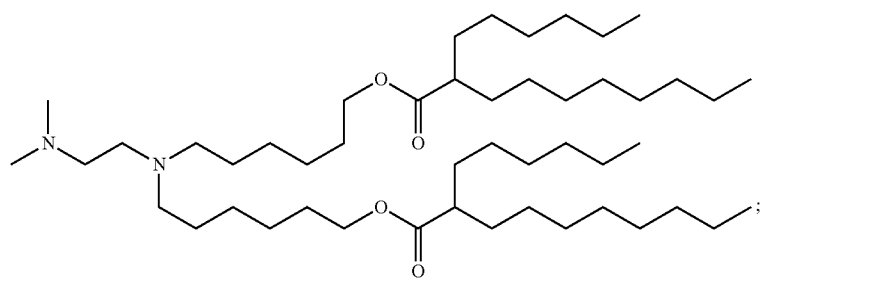
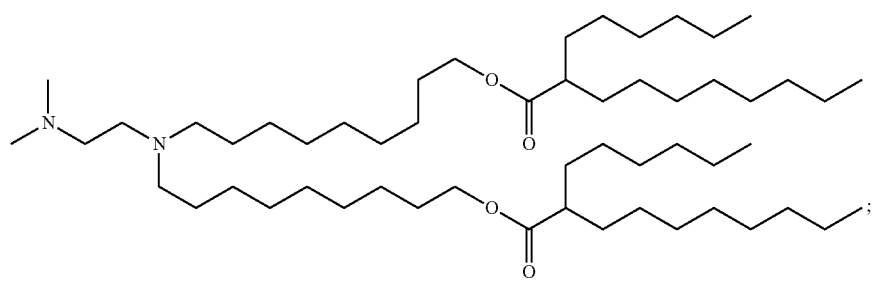
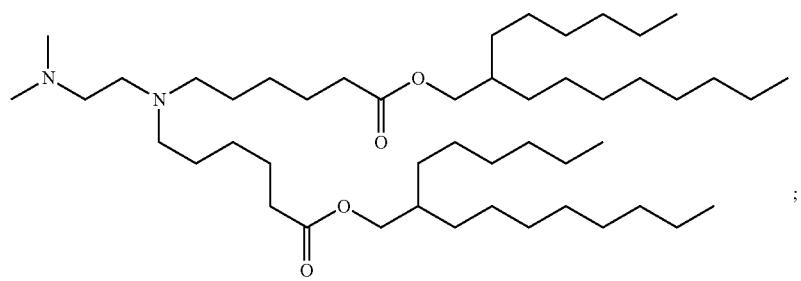
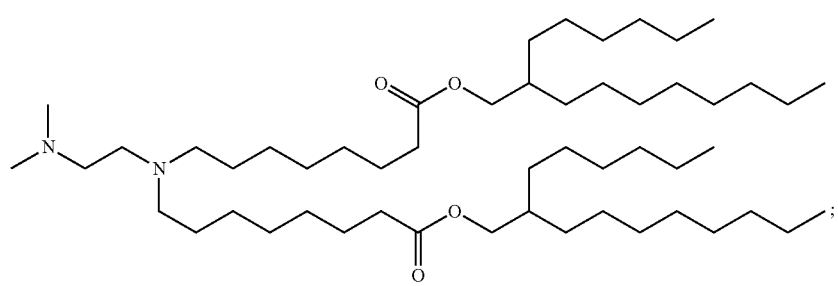

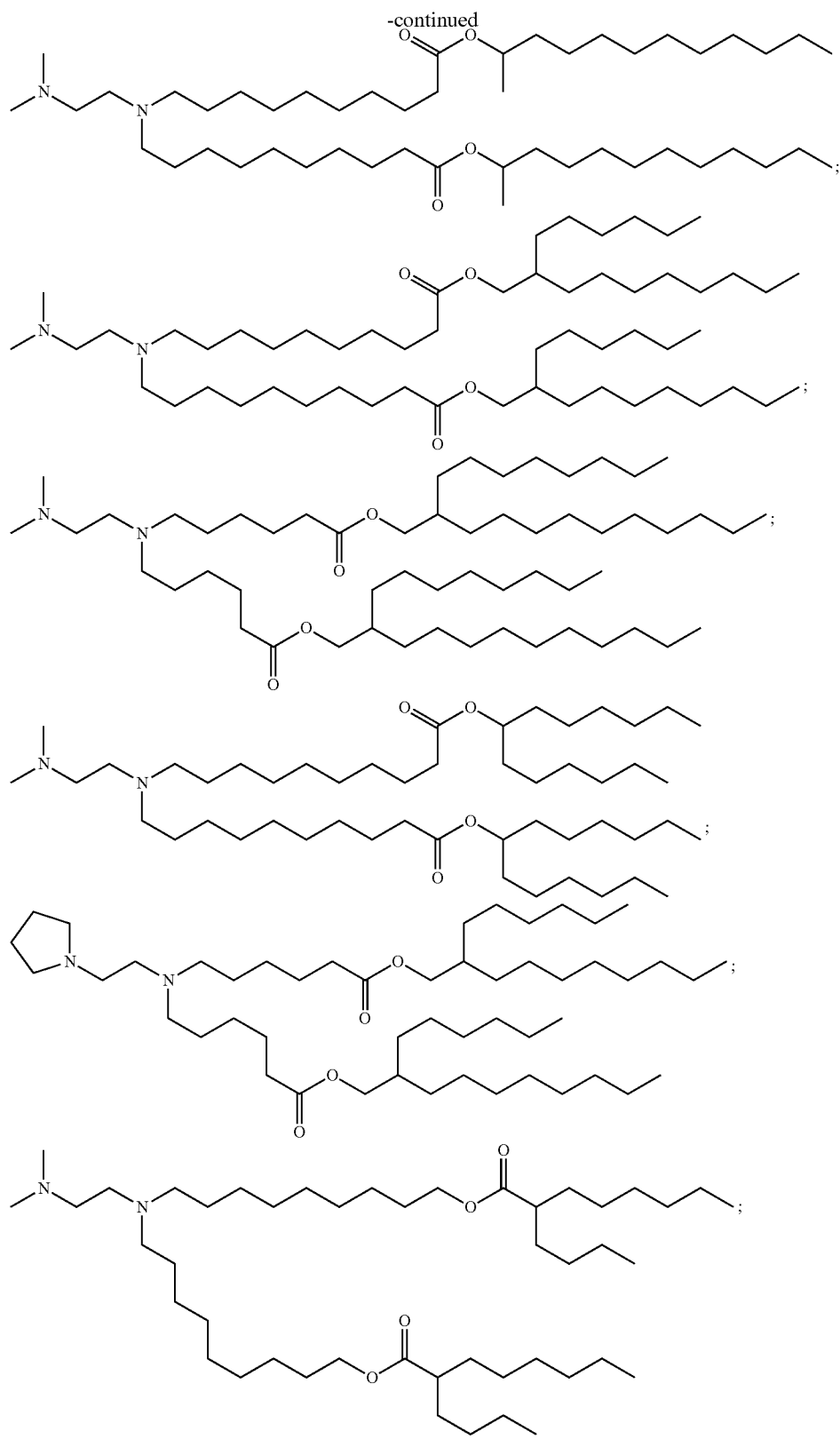

and any combination thereof.

(v) Other Lipid Composition Components

The lipid composition of a pharmaceutical composition disclosed herein can include one or more components in addition to those described above. For example, the lipid composition can include one or more permeability enhancer molecules, carbohydrates, polymers, surface altering agents (e.g., surfactants), or other components. For example, a permeability enhancer molecule can be a molecule described by U.S. Patent Application Publication No. 2005/0222064. Carbohydrates can include simple sugars (e.g., glucose) and polysaccharides (e.g., glycogen and derivatives and analogs thereof).

A polymer can be included in and/or used to encapsulate or partially encapsulate a pharmaceutical composition disclosed herein (e.g., a pharmaceutical composition in lipid nanoparticle form). A polymer can be biodegradable and/or biocompatible. A polymer can be selected from, but is not limited to, polyamines, polyethers, polyamides, polyesters, polycarbamates, polyureas, polycarbonates, polystyrenes, polyimides, polysulfones, polyurethanes, polyacetylenes, polyethylenes, polyethyleneimines, polyisocyanates, polyacrylates, polymethacrylates, polyacrylonitriles, and polyarylates.

The ratio between the lipid composition and the polynucleotide range can be from about 10:1 to about 60:1 (wt/wt).

In some embodiments, the ratio between the lipid composition and the polynucleotide can be about 10:1, 11:1, 12:1, 13:1, 14:1, 15:1, 16:1, 17:1, 18:1, 19:1, 20:1, 21:1, 22:1, 23:1, 24:1, 25:1, 26:1, 27:1, 28:1, 29:1, 30:1, 31:1, 32:1, 33:1, 34:1, 35:1, 36:1, 37:1, 38:1, 39:1, 40:1, 41:1, 42:1, 43:1, 44:1, 45:1, 46:1, 47:1, 48:1, 49:1, 50:1, 51:1, 52:1, 53:1, 54:1, 55:1, 56:1, 57:1, 58:1, 59:1 or 60:1 (wt/wt). In some embodiments, the wt/wt ratio of the lipid composition to the polynucleotide encoding a therapeutic agent is about 20:1 or about 15:1.

In one embodiment, the lipid nanoparticles described herein can comprise polynucleotides (e.g., mRNA) in a lipid:polynucleotide weight ratio of 5:1, 10:1, 15:1, 20:1, 25:1, 30:1, 35:1, 40:1, 45:1, 50:1, 55:1, 60:1 or 70:1, or a range or any of these ratios such as, but not limited to, 5:1 to about 10:1, from about 5:1 to about 15:1, from about 5:1 to about 20:1, from about 5:1 to about 25:1, from about 5:1 to about 30:1, from about 5:1 to about 35:1, from about 5:1 to about 40:1, from about 5:1 to about 45:1, from about 5:1 to about 50:1, from about 5:1 to about 55:1, from about 5:1 to about 60:1, from about 5:1 to about 70:1, from about 10:1 to about 15:1, from about 10:1 to about 20:1, from about 10:1 to about 25:1, from about 10:1 to about 30:1, from about 10:1 to about 35:1, from about 10:1 to about 40:1, from about 10:1 to about 45:1, from about 10:1 to about 50:1, from about 10:1 to about 55:1, from about 10:1 to about 60:1, from about 10:1 to about 70:1, from about 15:1 to about 20:1, from about 15:1 to about 25:1, from about 15:1 to about 30:1, from about 15:1 to about 35:1, from about 15:1 to about 40:1, from about 15:1 to about 45:1, from about 15:1 to about 50:1, from about 15:1 to about 55:1, from about 15:1 to about 60:1 or from about 15:1 to about 70:1.

In one embodiment, the lipid nanoparticles described herein can comprise the polynucleotide in a concentration from approximately 0.1 mg/ml to 2 mg/ml such as, but not limited to, 0.1 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.1 mg/ml, 1.2 mg/ml, 1.3 mg/ml, 1.4 mg/ml, 1.5 mg/ml, 1.6 mg/ml, 1.7 mg/ml, 1.8 mg/ml, 1.9 mg/ml, 2.0 mg/ml or greater than 2.0 mg/ml.

(vi) Nanoparticle Compositions

In some embodiments, the pharmaceutical compositions disclosed herein are formulated as lipid nanoparticles (LNP). Accordingly, the present disclosure also provides nanoparticle compositions comprising (i) a lipid composition comprising a delivery agent such as a compound of Formula (I) or (III) as described herein, and (ii) a polynucleotide encoding a relaxin polypeptide. In such nanoparticle composition, the lipid composition disclosed herein can encapsulate the polynucleotide encoding a relaxin polypeptide.

Nanoparticle compositions are typically sized on the order of micrometers or smaller and can include a lipid bilayer. Nanoparticle compositions encompass lipid nanoparticles (LNPs), liposomes (e.g., lipid vesicles), and lipoplexes. For example, a nanoparticle composition can be a liposome having a lipid bilayer with a diameter of 500 nm or less.

Nanoparticle compositions include, for example, lipid nanoparticles (LNPs), liposomes, and lipoplexes. In some embodiments, nanoparticle compositions are vesicles including one or more lipid bilayers. In certain embodiments, a nanoparticle composition includes two or more concentric bilayers separated by aqueous compartments. Lipid bilayers can be functionalized and/or crosslinked to one another. Lipid bilayers can include one or more ligands, proteins, or channels.

In some embodiments, the nanoparticle compositions of the present disclosure comprise at least one compound according to Formula (I), (III), (IV), (V), or (VI). For example, the nanoparticle composition can include one or more of Compounds 1-147, or one or more of Compounds 1-342. Nanoparticle compositions can also include a variety of other components. For example, the nanoparticle composition may include one or more other lipids in addition to a lipid according to Formula (I), (III), (IV), (V), or (VI), such as (i) at least one phospholipid, (ii) at least one structural lipid, (iii) at least one PEG-lipid, or (iv) any combination thereof. Inclusion of structural lipid can be optional, for example when lipids according to formula III are used in the lipid nanoparticle compositions of the invention.

In some embodiments, the nanoparticle composition comprises a compound of Formula (I), (e.g., Compounds 18, 25, 26 or 48). In some embodiments, the nanoparticle composition comprises a compound of Formula (I) (e.g., Compounds 18, 25, 26 or 48) and a phospholipid (e.g., DSPC).

In some embodiments, the nanoparticle composition comprises a compound of Formula (III) (e.g., Compound 236). In some embodiments, the nanoparticle composition comprises a compound of Formula (III) (e.g., Compound 236) and a phospholipid (e.g., DOPE or DSPC).

In some embodiments, the nanoparticle composition comprises a lipid composition consisting or consisting essentially of compound of Formula (I) (e.g., Compounds 18, 25, 26 or 48). In some embodiments, the nanoparticle composition comprises a lipid composition consisting or consisting essentially of a compound of Formula (I) (e.g., Compounds 18, 25, 26 or 48) and a phospholipid (e.g., DSPC).

In some embodiments, the nanoparticle composition comprises a lipid composition consisting or consisting essentially of compound of Formula (III) (e.g., Compound 236). In some embodiments, the nanoparticle composition comprises a lipid composition consisting or consisting essentially of a compound of Formula (III) (e.g., Compound 236) and a phospholipid (e.g., DOPE or DSPC).

In one embodiment, a lipid nanoparticle comprises an ionizable lipid, a structural lipid, a phospholipid, and mRNA. In some embodiments, the LNP comprises an ionizable lipid, a PEG-modified lipid, a sterol and a structural lipid. In some embodiments, the LNP has a molar ratio of about 20-60% ionizable lipid:about 5-25% structural lipid: about 25-55% sterol; and about 0.5-15% PEG-modified lipid. In some embodiments, the LNP comprises a molar ratio of about 50% ionizable lipid, about 1.5% PEG-modified lipid, about 38.5% cholesterol and about 10% structural lipid. In some embodiments, the LNP comprises a molar ratio of about 55% ionizable lipid, about 2.5% PEG lipid, about 32.5% cholesterol and about 10% structural lipid. In some embodiments, the ionizable lipid is an ionizable lipid and the structural lipid is a neutral lipid, and the sterol is a cholesterol. In some embodiments, the LNP has a molar ratio of 50:38.5:10:1.5 of ionizable lipid: cholesterol: DSPC: PEG lipid. In some embodiments, the ionizable lipid is Compound 18 or Compound 236, and the PEG lipid is Compound 428.

In some embodiments, the LNP has a molar ratio of 50:38.5:10:1.5 of Compound 18:Phospholipid:Cholesterol: Compound 428. In some embodiments, the LNP has a molar ratio of 50:38.5:10:1.5 of Compound 18:DSPC:Cholesterol: Compound 428.

In some embodiments, the LNP has a molar ratio of 50:38.5:10:1.5 of Compound 236:Phospholipid:Cholesterol: Compound 428. In some embodiments, the LNP has a molar ratio of 50:38.5:10:1.5 of Compound 236:DSPC:Cholesterol:Compound 428.

In some embodiments, the LNP has a polydispersity value of less than 0.4. In some embodiments, the LNP has a net neutral charge at a neutral pH. In some embodiments, the LNP has a mean diameter of 50-150 nm. In some embodiments, the LNP has a mean diameter of 80-100 nm.

As generally defined herein, the term "lipid" refers to a small molecule that has hydrophobic or amphiphilic properties. Lipids may be naturally occurring or synthetic. Examples of classes of lipids include, but are not limited to, fats, waxes, sterol-containing metabolites, vitamins, fatty acids, glycerolipids, glycerophospholipids, sphingolipids, saccharolipids, and polyketides, and prenol lipids. In some instances, the amphiphilic properties of some lipids leads them to form liposomes, vesicles, or membranes in aqueous media.

In some embodiments, a lipid nanoparticle (LNP) may comprise an ionizable lipid. As used herein, the term "ionizable lipid" has its ordinary meaning in the art and may refer to a lipid comprising one or more charged moieties. In some embodiments, an ionizable lipid may be positively charged or negatively charged. An ionizable lipid may be positively charged, in which case it can be referred to as "cationic lipid". In certain embodiments, an ionizable lipid molecule may comprise an amine group, and can be referred to as an ionizable amino lipids. As used herein, a "charged moiety" is a chemical moiety that carries a formal electronic charge, e.g., monovalent (+1, or −1), divalent (+2, or −2), trivalent (+3, or −3), etc. The charged moiety may be anionic (i.e., negatively charged) or cationic (i.e., positively charged). Examples of positively-charged moieties include amine groups (e.g., primary, secondary, and/or tertiary amines), ammonium groups, pyridinium group, guanidine groups, and imidizolium groups. In a particular embodiment, the charged moieties comprise amine groups. Examples of negatively-charged groups or precursors thereof, include carboxylate groups, sulfonate groups, sulfate groups, phosphonate groups, phosphate groups, hydroxyl groups, and the like. The charge of the charged moiety may vary, in some cases, with the environmental conditions, for example, changes in pH may alter the charge of the moiety, and/or cause the moiety to become charged or uncharged. In general, the charge density of the molecule may be selected as desired.

It should be understood that the terms "charged" or "charged moiety" does not refer to a "partial negative charge" or "partial positive charge" on a molecule. The terms "partial negative charge" and "partial positive charge" are given its ordinary meaning in the art. A "partial negative charge" may result when a functional group comprises a bond that becomes polarized such that electron density is pulled toward one atom of the bond, creating a partial negative charge on the atom. Those of ordinary skill in the art will, in general, recognize bonds that can become polarized in this way.

In some embodiments, the ionizable lipid is an ionizable amino lipid, sometimes referred to in the art as an "ionizable cationic lipid". In one embodiment, the ionizable amino lipid may have a positively charged hydrophilic head and a hydrophobic tail that are connected via a linker structure.

In addition to these, an ionizable lipid may also be a lipid including a cyclic amine group.

In one embodiment, the ionizable lipid may be selected from, but not limited to, a ionizable lipid described in International Publication Nos. WO2013086354 and WO2013116126; the contents of each of which are herein incorporated by reference in their entirety.

In yet another embodiment, the ionizable lipid may be selected from, but not limited to, formula CLI-CLXXXXII of U.S. Pat. No. 7,404,969; each of which is herein incorporated by reference in their entirety.

In one embodiment, the lipid may be a cleavable lipid such as those described in International Publication No. WO2012170889, herein incorporated by reference in its entirety. In one embodiment, the lipid may be synthesized by methods known in the art and/or as described in International Publication Nos. WO2013086354; the contents of each of which are herein incorporated by reference in their entirety.

Nanoparticle compositions can be characterized by a variety of methods. For example, microscopy (e.g., transmission electron microscopy or scanning electron microscopy) can be used to examine the morphology and size distribution of a nanoparticle composition. Dynamic light scattering or potentiometry (e.g., potentiometric titrations) can be used to measure zeta potentials. Dynamic light scattering can also be utilized to determine particle sizes. Instruments such as the Zetasizer Nano ZS (Malvern Instruments Ltd, Malvern, Worcestershire, UK) can also be used to measure multiple characteristics of a nanoparticle composition, such as particle size, polydispersity index, and zeta potential.

In some embodiments, the nanoparticle composition comprises a lipid composition consisting or consisting essentially of compound of Formula (I) (e.g., Compounds 18, 25, 26 or 48). In some embodiments, the nanoparticle composition comprises a lipid composition consisting or consisting essentially of a compound of Formula (I) (e.g., Compounds 18, 25, 26 or 48) and a phospholipid (e.g., DSPC or MSPC).

Nanoparticle compositions can be characterized by a variety of methods. For example, microscopy (e.g., transmission electron microscopy or scanning electron microscopy) can be used to examine the morphology and size distribution of a nanoparticle composition. Dynamic light scattering or potentiometry (e.g., potentiometric titrations) can be used to measure zeta potentials. Dynamic light scattering can also be utilized to determine particle sizes. Instruments such as the Zetasizer Nano ZS (Malvern Instruments Ltd, Malvern, Worcestershire, UK) can also be used to measure multiple characteristics of a nanoparticle composition, such as particle size, polydispersity index, and zeta potential.

The size of the nanoparticles can help counter biological reactions such as, but not limited to, inflammation, or can increase the biological effect of the polynucleotide.

As used herein, "size" or "mean size" in the context of nanoparticle compositions refers to the mean diameter of a nanoparticle composition.

In one embodiment, the polynucleotide encoding a relaxin polypeptide are formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm, about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the nanoparticles have a diameter from about 10 to 500 nm. In one embodiment, the nanoparticle has a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the largest dimension of a nanoparticle composition is 1 am or shorter (e.g., 1 am, 900 nm, 800 nm, 700 nm, 600 nm, 500 nm, 400 nm, 300 nm, 200 nm, 175 nm, 150 nm, 125 nm, 100 nm, 75 nm, 50 nm, or shorter).

A nanoparticle composition can be relatively homogenous. A polydispersity index can be used to indicate the homogeneity of a nanoparticle composition, e.g., the particle size distribution of the nanoparticle composition. A small (e.g., less than 0.3) polydispersity index generally indicates a narrow particle size distribution. A nanoparticle composition can have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a nanoparticle composition disclosed herein can be from about 0.10 to about 0.20.

The zeta potential of a nanoparticle composition can be used to indicate the electrokinetic potential of the composition. For example, the zeta potential can describe the surface charge of a nanoparticle composition. Nanoparticle compositions with relatively low charges, positive or negative, are generally desirable, as more highly charged species can interact undesirably with cells, tissues, and other elements in the body. In some embodiments, the zeta potential of a nanoparticle composition disclosed herein can be from about −10 mV to about +20 mV, from about −10 mV to about +15 mV, from about 10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

In some embodiments, the zeta potential of the lipid nanoparticles can be from about 0 mV to about 100 mV, from about 0 mV to about 90 mV, from about 0 mV to about 80 mV, from about 0 mV to about 70 mV, from about 0 mV to about 60 mV, from about 0 mV to about 50 mV, from about 0 mV to about 40 mV, from about 0 mV to about 30 mV, from about 0 mV to about 20 mV, from about 0 mV to about 10 mV, from about 10 mV to about 100 mV, from about 10 mV to about 90 mV, from about 10 mV to about 80 mV, from about 10 mV to about 70 mV, from about 10 mV to about 60 mV, from about 10 mV to about 50 mV, from about 10 mV to about 40 mV, from about 10 mV to about 30 mV, from about 10 mV to about 20 mV, from about 20 mV to about 100 mV, from about 20 mV to about 90 mV, from about 20 mV to about 80 mV, from about 20 mV to about 70 mV, from about 20 mV to about 60 mV, from about 20 mV to about 50 mV, from about 20 mV to about 40 mV, from about 20 mV to about 30 mV, from about 30 mV to about 100 mV, from about 30 mV to about 90 mV, from about 30 mV to about 80 mV, from about 30 mV to about 70 mV, from about 30 mV to about 60 mV, from about 30 mV to about 50 mV, from about 30 mV to about 40 mV, from about 40 mV to about 100 mV, from about 40 mV to about 90 mV, from about 40 mV to about 80 mV, from about 40 mV to about 70 mV, from about 40 mV to about 60 mV, and from about 40 mV to about 50 mV. In some embodiments, the zeta potential of the lipid nanoparticles can be from about 10 mV to about 50 mV, from about 15 mV to about 45 mV, from about 20 mV to about 40 mV, and from about 25 mV to about 35 mV. In some embodiments, the zeta potential of the lipid nanoparticles can be about 10 mV, about 20 mV, about 30 mV, about 40 mV, about 50 mV, about 60 mV, about 70 mV, about 80 mV, about 90 mV, and about 100 mV.

The term "encapsulation efficiency" of a polynucleotide describes the amount of the polynucleotide that is encapsulated by or otherwise associated with a nanoparticle composition after preparation, relative to the initial amount provided. As used herein, "encapsulation" can refer to complete, substantial, or partial enclosure, confinement, surrounding, or encasement.

Encapsulation efficiency is desirably high (e.g., close to 100%). The encapsulation efficiency can be measured, for example, by comparing the amount of the polynucleotide in a solution containing the nanoparticle composition before and after breaking up the nanoparticle composition with one or more organic solvents or detergents.

Fluorescence can be used to measure the amount of free polynucleotide in a solution. For the nanoparticle compositions described herein, the encapsulation efficiency of a polynucleotide can be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency can be at least 80%. In certain embodiments, the encapsulation efficiency can be at least 90%.

The amount of a polynucleotide present in a pharmaceutical composition disclosed herein can depend on multiple factors such as the size of the polynucleotide, desired target and/or application, or other properties of the nanoparticle composition as well as on the properties of the polynucleotide.

For example, the amount of an mRNA useful in a nanoparticle composition can depend on the size (expressed as length, or molecular mass), sequence, and other characteristics of the mRNA. The relative amounts of a polynucleotide in a nanoparticle composition can also vary.

The relative amounts of the lipid composition and the polynucleotide present in a lipid nanoparticle composition of the present disclosure can be optimized according to considerations of efficacy and tolerability. For compositions including an mRNA as a polynucleotide, the N:P ratio can serve as a useful metric.

As the N:P ratio of a nanoparticle composition controls both expression and tolerability, nanoparticle compositions with low N:P ratios and strong expression are desirable. N:P ratios vary according to the ratio of lipids to RNA in a nanoparticle composition.

In general, a lower N:P ratio is preferred. The one or more RNA, lipids, and amounts thereof can be selected to provide an N:P ratio from about 2:1 to about 30:1, such as 2:1, 3:1, 4:1, 5:1, 6:1, 7:1, 8:1, 9:1, 10:1, 12:1, 14:1, 16:1, 18:1, 20:1, 22:1, 24:1, 26:1, 28:1, or 30:1. In certain embodiments, the N:P ratio can be from about 2:1 to about 8:1. In other embodiments, the N:P ratio is from about 5:1 to about 8:1. In certain embodiments, the N:P ratio is between 5:1 and 6:1. In one specific aspect, the N:P ratio is about is about 5.67:1.

In addition to providing nanoparticle compositions, the present disclosure also provides methods of producing lipid nanoparticles comprising encapsulating a polynucleotide. Such method comprises using any of the pharmaceutical compositions disclosed herein and producing lipid nanoparticles in accordance with methods of production of lipid nanoparticles known in the art. See, e.g., Wang et al. (2015) "Delivery of oligonucleotides with lipid nanoparticles" Adv. Drug Deliv. Rev. 87:68-80; Silva et al. (2015) "Delivery Systems for Biopharmaceuticals. Part I: Nanoparticles and Microparticles" Curr. Pharm. Technol. 16: 940-954; Naseri et al. (2015) "Solid Lipid Nanoparticles and Nanostructured Lipid Carriers: Structure, Preparation and Application" Adv. Pharm. Bull. 5:305-13; Silva et al. (2015) "Lipid nanoparticles for the delivery of biopharmaceuticals" Curr. Pharm. Biotechnol. 16:291-302, and references cited therein.

Other Delivery Agents a. Liposomes, Lipoplexes, and Lipid Nanoparticles

In some embodiments, the compositions or formulations of the present disclosure comprise a delivery agent, e.g., a liposome, a lioplexes, a lipid nanoparticle, or any combination thereof. The polynucleotides described herein (e.g., a polynucleotide comprising a nucleotide sequence encoding a relaxin polypeptide) can be formulated using one or more liposomes, lipoplexes, or lipid nanoparticles. Liposomes, lipoplexes, or lipid nanoparticles can be used to improve the efficacy of the polynucleotides directed protein production as these formulations can increase cell transfection by the polynucleotide; and/or increase the translation of encoded protein. The liposomes, lipoplexes, or lipid nanoparticles can also be used to increase the stability of the polynucleotides.

Liposomes are artificially-prepared vesicles that can primarily be composed of a lipid bilayer and can be used as a delivery vehicle for the administration of pharmaceutical formulations. Liposomes can be of different sizes. A multilamellar vesicle (MLV) can be hundreds of nanometers in diameter, and can contain a series of concentric bilayers separated by narrow aqueous compartments. A small unicellular vesicle (SUV) can be smaller than 50 nm in diameter, and a large unilamellar vesicle (LUV) can be between 50 and 500 nm in diameter. Liposome design can include, but is not limited to, opsonins or ligands to improve the attachment of liposomes to unhealthy tissue or to activate events such as, but not limited to, endocytosis. Liposomes can contain a low or a high pH value in order to improve the delivery of the pharmaceutical formulations.

The formation of liposomes can depend on the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimal size, polydispersity and the shelf-life of the vesicles for the intended application, and the batch-to-batch reproducibility and scale up production of safe and efficient liposomal products, etc.

As a non-limiting example, liposomes such as synthetic membrane vesicles can be prepared by the methods, apparatus and devices described in U.S. Pub. Nos. US20130177638, US20130177637, US20130177636, US20130177635, US20130177634, US20130177633, US20130183375, US20130183373, and US20130183372. In some embodiments, the polynucleotides described herein can be encapsulated by the liposome and/or it can be contained in an aqueous core that can then be encapsulated by the liposome as described in, e.g., Intl. Pub. Nos. WO2012031046, WO2012031043, WO2012030901, WO2012006378, and WO2013086526; and U.S. Pub. Nos. US20130189351, US20130195969 and US20130202684. Each of the references in herein incorporated by reference in its entirety.

In some embodiments, the polynucleotides described herein can be formulated in a cationic oil-in-water emulsion where the emulsion particle comprises an oil core and a cationic lipid that can interact with the polynucleotide anchoring the molecule to the emulsion particle. In some embodiments, the polynucleotides described herein can be formulated in a water-in-oil emulsion comprising a continuous hydrophobic phase in which the hydrophilic phase is dispersed. Exemplary emulsions can be made by the methods described in Intl. Pub. Nos. WO2012006380 and WO201087791, each of which is herein incorporated by reference in its entirety.

In some embodiments, the polynucleotides described herein can be formulated in a lipid-polycation complex. The formation of the lipid-polycation complex can be accomplished by methods as described in, e.g., U.S. Pub. No. US20120178702. As a non-limiting example, the polycation can include a cationic peptide or a polypeptide such as, but not limited to, polylysine, polyornithine and/or polyarginine and the cationic peptides described in Intl. Pub. No. WO2012013326 or U.S. Pub. No. US20130142818. Each of the references is herein incorporated by reference in its entirety.

In some embodiments, the polynucleotides described herein can be formulated in a lipid nanoparticle (LNP) such as those described in Intl. Pub. Nos. WO2013123523, WO2012170930, WO2011127255 and WO2008103276; and U.S. Pub. No. US20130171646, each of which is herein incorporated by reference in its entirety.

Lipid nanoparticle formulations typically comprise one or more lipids. In some embodiments, the lipid is a cationic or an ionizable lipid. In some embodiments, lipid nanoparticle formulations further comprise other components, including a phospholipid, a structural lipid, a quaternary amine compound, and a molecule capable of reducing particle aggregation, for example a PEG or PEG-modified lipid.

Cationic and ionizable lipids can include those as described in, e.g., Intl. Pub. Nos. WO2015199952, WO 2015130584, WO 2015011633, and WO2012040184 WO2013126803, WO2011153120, WO2011149733, WO2011090965, WO2011043913, WO2011022460, WO2012061259, WO2012054365, WO2012044638, WO2010080724, WO201021865, WO2008103276, and WO2013086373; U.S. Pat. Nos. 7,893,302, 7,404,969, 8,283,333, and 8,466,122; and U.S. Pub. Nos. US20110224447, US20120295832, US20150315112, US20100036115, US20120202871, US20130064894, US20130129785, US20130150625, US20130178541, US20130123338 and US20130225836, each of which is herein incorporated by reference in its entirety. In some embodiments, the amount of the cationic and ionizable lipids in the lipid composition ranges from about 0.01 mol % to about 99 mol %.

Exemplary ionizable lipids include, but not limited to, any one of Compounds 1-147 disclosed herein, DLin-MC3-DMA (MC3), DLin-DMA, DLenDMA, DLin-D-DMA, DLin-K-DMA, DLin-M-C2-DMA, DLin-K-DMA, DLin-KC2-DMA, DLin-KC3-DMA, DLin-KC4-DMA, DLin-C2K-DMA, DLin-MP-DMA, DODMA, 98N12-5, C12-200, DLin-C-DAP, DLin-DAC, DLinDAP, DLinAP, DLin-EG-DMA, DLin-2-DMAP, KL10, KL22, KL25, Octyl-CLinDMA, Octyl-CLinDMA (2R), Octyl-CLinDMA (2S), and any combination thereof. Other exemplary ionizable lipids include, (13Z,16Z)—N,N-dimethyl-3-nonyldocosa-13,16-dien-1-amine (L608), (20Z,23Z)—N,N-dimethyl-nonacosa-20,23-dien-10-amine, (17Z,20Z)—N,N-dimemyl-hexacosa-17,20-dien-9-amine, (16Z,19Z)—N5N-dimethylpentacosa-16,19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyl eptacos-15-en-1 0-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl] nonadecan-10-amine, N,N-dimethyl-21-[(1S,2R)-2-octylcyclopropyl]henicosan-10-amine, N,N-dimethyl-1-[(1S,2S)-2-{[(1R,2R)-2-pentylcyclopropyl] methyl}cyclopropyl]nonadecan-10-amine, N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl] heptyl}dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy) propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl] ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy) propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy) propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentyl-cyclopropyl]methyl}cyclopropyl]octyl}oxy)propan-2-amine, N,N-dimethyl-1-{[8-(2-oclylcyclopropyl)octyl] oxy}-3-(octyloxy)propan-2-amine, and (11E,20Z,23Z)—N,N-dimethylnonacosa-11,20,2-trien-10-amine, and any combination thereof.

Phospholipids include, but are not limited to, glycerophospholipids such as phosphatidylcholines, phosphatidylethanolamines, phosphatidylserines, phosphatidylinositols, phosphatidy glycerols, and phosphatidic acids. Phospholipids also include phosphosphingolipid, such as sphingomyelin. In some embodiments, the phospholipids are DLPC, DMPC, DOPC, DPPC, DSPC, DUPC, 18:0 Diether PC, DLnPC, DAPC, DHAPC, DOPE, 4ME 16:0 PE, DSPE, DLPE, DLnPE, DAPE, DHAPE, DOPG, and any combination thereof. In some embodiments, the phospholipids are MPPC, MSPC, PMPC, PSPC, SMPC, SPPC, DHAPE, DOPG, and any combination thereof. In some embodiments, the amount of phospholipids (e.g., DSPC) in the lipid composition ranges from about 1 mol % to about 20 mol %.

The structural lipids include sterols and lipids containing sterol moieties. In some embodiments, the structural lipids include cholesterol, fecosterol, sitosterol, ergosterol, campesterol, stigmasterol, brassicasterol, tomatidine, tomatine, ursolic acid, alpha-tocopherol, and mixtures thereof. In some embodiments, the structural lipid is cholesterol. In some embodiments, the amount of the structural lipids (e.g., cholesterol) in the lipid composition ranges from about 20 mol % to about 60 mol %.

The PEG-modified lipids include PEG-modified phosphatidylethanolamine and phosphatidic acid, PEG-ceramide conjugates (e.g., PEG-CerC14 or PEG-CerC20), PEG-modified dialkylamines and PEG-modified 1,2-diacyloxypropan-3-amines. Such lipids are also referred to as PEGylated lipids. For example, a PEG lipid can be PEG-c-DOMG, PEG-DMG, PEG-DLPE, PEG DMPE, PEG-DPPC, or a PEG-DSPE lipid. In some embodiments, the PEG-lipid are 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DSG), PEG-dipalmetoleyl, PEG-dioleyl, PEG-disteary1, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA). In some embodiments, the PEG moiety has a size of about 1000, 2000, 5000, 10,000, 15,000 or 20,000 daltons. In some embodiments, the amount of PEG-lipid in the lipid composition ranges from about 0.1 mol % to about 5 mol %.

In some embodiments, the LNP formulations described herein can additionally comprise a permeability enhancer molecule. Non-limiting permeability enhancer molecules are described in U.S. Pub. No. US20050222064, herein incorporated by reference in its entirety.

The LNP formulations can further contain a phosphate conjugate. The phosphate conjugate can increase in vivo circulation times and/or increase the targeted delivery of the nanoparticle. Phosphate conjugates can be made by the methods described in, e.g., Intl. Pub. No. WO2013033438 or U.S. Pub. No. US20130196948. The LNP formulation can also contain a polymer conjugate (e.g., a water soluble conjugate) as described in, e.g., U.S. Pub. Nos. US20130059360, US20130196948, and US20130072709. Each of the references is herein incorporated by reference in its entirety.

The LNP formulations can comprise a conjugate to enhance the delivery of nanoparticles of the present invention in a subject. Further, the conjugate can inhibit phagocytic clearance of the nanoparticles in a subject. In some embodiments, the conjugate can be a "self" peptide designed from the human membrane protein CD47 (e.g., the "self" particles described by Rodriguez et al, Science 2013 339, 971-975, herein incorporated by reference in its entirety). As shown by Rodriguez et al. the self peptides delayed macrophage-mediated clearance of nanoparticles which enhanced delivery of the nanoparticles.

The LNP formulations can comprise a carbohydrate carrier. As a non-limiting example, the carbohydrate carrier can include, but is not limited to, an anhydride-modified phytoglycogen or glycogen-type material, phytoglycogen octenyl succinate, phytoglycogen beta-dextrin, anhydride-modified phytoglycogen beta-dextrin (e.g., Intl. Pub. No. WO2012109121, herein incorporated by reference in its entirety).

The LNP formulations can be coated with a surfactant or polymer to improve the delivery of the particle. In some embodiments, the LNP can be coated with a hydrophilic coating such as, but not limited to, PEG coatings and/or coatings that have a neutral surface charge as described in U.S. Pub. No. US20130183244, herein incorporated by reference in its entirety.

The LNP formulations can be engineered to alter the surface properties of particles so that the lipid nanoparticles can penetrate the mucosal barrier as described in U.S. Pat. No. 8,241,670 or Intl. Pub. No. WO2013110028, each of which is herein incorporated by reference in its entirety.

The LNP engineered to penetrate mucus can comprise a polymeric material (i.e., a polymeric core) and/or a polymer-vitamin conjugate and/or a tri-block co-polymer. The polymeric material can include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates.

LNP engineered to penetrate mucus can also include surface altering agents such as, but not limited to, polynucleotides, anionic proteins (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase.

In some embodiments, the mucus penetrating LNP can be a hypotonic formulation comprising a mucosal penetration enhancing coating. The formulation can be hypotonic for the epithelium to which it is being delivered. Non-limiting examples of hypotonic formulations can be found in, e.g., Intl. Pub. No. WO2013110028, herein incorporated by reference in its entirety.

In some embodiments, the polynucleotide described herein is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In some embodiments, the polynucleotides described herein are formulated as a solid lipid nanoparticle (SLN), which can be spherical with an average diameter between 10 to 1000 nm. SLN possess a solid lipid core matrix that can solubilize lipophilic molecules and can be stabilized with surfactants and/or emulsifiers. Exemplary SLN can be those as described in Intl. Pub. No. WO2013105101, herein incorporated by reference in its entirety.

In some embodiments, the polynucleotides described herein can be formulated for controlled release and/or targeted delivery. As used herein, "controlled release" refers to a pharmaceutical composition or compound release profile that conforms to a particular pattern of release to effect a therapeutic outcome. In one embodiment, the polynucleotides can be encapsulated into a delivery agent described herein and/or known in the art for controlled release and/or targeted delivery. As used herein, the term "encapsulate" means to enclose, surround or encase. As it relates to the formulation of the compounds of the invention, encapsulation can be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the invention can be enclosed, surrounded or encased within the delivery agent. "Partially encapsulation" means that less than 10, 10, 20, 30, 40 50 or less of the pharmaceutical composition or compound of the invention can be enclosed, surrounded or encased within the delivery agent.

Advantageously, encapsulation can be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In some embodiments, the polynucleotide controlled release formulation can include at least one controlled release coating (e.g., OPADRY®, EUDRAGIT RL®, EUDRAGIT RS® and cellulose derivatives such as ethylcellulose aqueous dispersions (AQUACOAT® and SURELEASE®)). In some embodiments, the polynucleotide controlled release formulation can comprise a polymer system as described in U.S. Pub. No. US20130130348, or a PEG and/or PEG related polymer derivative as described in U.S. Pat. No. 8,404,222, each of which is incorporated by reference in its entirety.

In some embodiments, the polynucleotides described herein can be encapsulated in a therapeutic nanoparticle, referred to herein as "therapeutic nanoparticle polynucleotides." Therapeutic nanoparticles can be formulated by methods described in, e.g., Intl. Pub. Nos. WO2010005740, WO2010030763, WO2010005721, WO2010005723, and WO2012054923; and U.S. Pub. Nos. US20110262491, US20100104645, US20100087337, US20100068285, US20110274759, US20100068286, US20120288541, US20120140790, US20130123351 and US20130230567; and U.S. Pat. Nos. 8,206,747, 8,293,276, 8,318,208 and 8,318,211, each of which is herein incorporated by reference in its entirety.

In some embodiments, the therapeutic nanoparticle polynucleotide can be formulated for sustained release. As used herein, "sustained release" refers to a pharmaceutical composition or compound that conforms to a release rate over a specific period of time. The period of time can include, but is not limited to, hours, days, weeks, months and years. As a non-limiting example, the sustained release nanoparticle of the polynucleotides described herein can be formulated as disclosed in Intl. Pub. No. WO2010075072 and U.S. Pub. Nos. US20100216804, US20110217377, US20120201859 and US20130150295, each of which is herein incorporated by reference in their entirety.

In some embodiments, the therapeutic nanoparticle polynucleotide can be formulated to be target specific, such as those described in Intl. Pub. Nos. WO2008121949, WO2010005726, WO2010005725, WO2011084521 and WO2011084518; and U.S. Pub. Nos. US20100069426, US20120004293 and US20100104655, each of which is herein incorporated by reference in its entirety.

The LNPs can be prepared using microfluidic mixers or micromixers. Exemplary microfluidic mixers can include, but are not limited to, a slit interdigitial micromixer including, but not limited to those manufactured by Microinnova (Allerheiligen bei Wildon, Austria) and/or a staggered herringbone micromixer (SHM) (see Zhigaltsev et al., "Bottom-up design and synthesis of limit size lipid nanoparticle systems with aqueous and triglyceride cores using millisecond microfluidic mixing," Langmuir 28:3633-40 (2012); Belliveau et al., "Microfluidic synthesis of highly potent limit-size lipid nanoparticles for in vivo delivery of siRNA," Molecular Therapy-Nucleic Acids. 1:e37 (2012); Chen et al., "Rapid discovery of potent siRNA-containing lipid nanoparticles enabled by controlled microfluidic formulation," J. Am. Chem. Soc. 134(16):6948-51 (2012); each of which is herein incorporated by reference in its entirety). Exemplary micromixers include Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany. In some embodiments, methods of making LNP using SHM further comprise mixing at least two input streams wherein mixing occurs by microstructure-induced chaotic advection (MICA). According to this method, fluid streams flow through channels present in a herringbone pattern causing rotational flow and folding the fluids around each other. This method can also comprise a surface for fluid mixing wherein the surface changes orientations during fluid cycling. Methods of generating LNPs using SHM include those disclosed in U.S. Pub. Nos. US20040262223 and US20120276209, each of which is incorporated herein by reference in their entirety.

In some embodiments, the polynucleotides described herein can be formulated in lipid nanoparticles using microfluidic technology (see Whitesides, George M., "The Origins and the Future of Microfluidics," Nature 442: 368-373 (2006); and Abraham et al., "Chaotic Mixer for Microchannels," Science 295: 647-651 (2002); each of which is herein incorporated by reference in its entirety). In some embodiments, the polynucleotides can be formulated in lipid nanoparticles using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In some embodiments, the polynucleotides described herein can be formulated in lipid nanoparticles having a diameter from about 1 nm to about 100 nm such as, but not limited to, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In some embodiments, the lipid nanoparticles can have a diameter from about 10 to 500 nm. In one embodiment, the lipid nanoparticle can have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the polynucleotides can be delivered using smaller LNPs. Such particles can comprise a diameter from below 0.1 μm up to 100 nm such as, but not limited to, less than 0.1 μm, less than 1.0 μm, less than 5 μm, less than 10 μm, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, or less than 975 um.

The nanoparticles and microparticles described herein can be geometrically engineered to modulate macrophage and/or the immune response. The geometrically engineered particles can have varied shapes, sizes and/or surface charges to incorporate the polynucleotides described herein for targeted delivery such as, but not limited to, pulmonary delivery (see, e.g., Intl. Pub. No. WO2013082111, herein incorporated by reference in its entirety). Other physical features the geometrically engineering particles can include, but are not limited to, fenestrations, angled arms, asymmetry and surface roughness, charge that can alter the interactions with cells and tissues.

In some embodiment, the nanoparticles described herein are stealth nanoparticles or target-specific stealth nanoparticles such as, but not limited to, those described in U.S. Pub. No. US20130172406, herein incorporated by reference in its entirety. The stealth or target-specific stealth nanoparticles can comprise a polymeric matrix, which can comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates, or combinations thereof.

As a non-limiting example modified mRNA can be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradable, biocompatible polymers that are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C.

As a non-limiting example, the polynucleotides described herein can be formulated with the polymeric compound of PEG grafted with PLL as described in U.S. Pat. No. 6,177,274. As another non-limiting example, the polynucleotides described herein can be formulated with a block copolymer such as a PLGA-PEG block copolymer (see e.g., U.S. Pub. No. US20120004293 and U.S. Pat. Nos. 8,236,330 and 8,246,968), or a PLGA-PEG-PLGA block copolymer (see e.g., U.S. Pat. No. 6,004,573). Each of the references is herein incorporated by reference in its entirety.

In some embodiments, the polynucleotides described herein can be formulated with at least one amine-containing polymer such as, but not limited to polylysine, polyethylene imine, poly(amidoamine) dendrimers, poly(amine-co-esters) or combinations thereof. Exemplary polyamine polymers and their use as delivery agents are described in, e.g., U.S. Pat. Nos. 8,460,696, 8,236,280, each of which is herein incorporated by reference in its entirety.

In some embodiments, the polynucleotides described herein can be formulated in a biodegradable cationic lipopolymer, a biodegradable polymer, or a biodegradable copolymer, a biodegradable polyester copolymer, a biodegradable polyester polymer, a linear biodegradable copolymer, PAGA, a biodegradable cross-linked cationic multi-block copolymer or combinations thereof as described in, e.g., U.S. Pat. Nos. 6,696,038, 6,517,869, 6,267,987, 6,217,912, 6,652,886, 8,057,821, and 8,444,992; U.S. Pub. Nos. US20030073619, US20040142474, US20100004315, US2012009145 and US20130195920; and Intl Pub. Nos. WO2006063249 and WO2013086322, each of which is herein incorporated by reference in its entirety.

In some embodiments, the polynucleotides disclosed herein can be formulated as a nanoparticle using a combination of polymers, lipids, and/or other biodegradable agents, such as, but not limited to, calcium phosphate. Components can be combined in a core-shell, hybrid, and/or layer-by-layer architecture, to allow for fine-tuning of the nanoparticle for delivery (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in their entireties). As a non-limiting example, the nanoparticle can comprise a plurality of polymers such as, but not limited to hydrophilic-hydrophobic polymers (e.g., PEG-PLGA), hydrophobic polymers (e.g., PEG) and/or hydrophilic polymers (Intl. Pub. No. WO20120225129, herein incorporated by reference in its entirety).

The use of core-shell nanoparticles has additionally focused on a high-throughput approach to synthesize cationic cross-linked nanogel cores and various shells (Siegwart et al., Proc Natl Acad Sci USA. 2011 108:12996-13001; herein incorporated by reference in its entirety). The complexation, delivery, and internalization of the polymeric nanoparticles can be precisely controlled by altering the chemical composition in both the core and shell components of the nanoparticle. For example, the core-shell nanoparticles can efficiently deliver siRNA to mouse hepatocytes after they covalently attach cholesterol to the nanoparticle.

In some embodiments, a hollow lipid core comprising a middle PLGA layer and an outer neutral lipid layer containing PEG can be used to delivery of the polynucleotides as described herein. In some embodiments, the lipid nanoparticles can comprise a core of the polynucleotides disclosed herein and a polymer shell, which is used to protect the polynucleotides in the core. The polymer shell can be any of the polymers described herein and are known in the art, the polymer shell can be used to protect the polynucleotides in the core.

Core-shell nanoparticles for use with the polynucleotides described herein are described in U.S. Pat. No. 8,313,777 or Intl. Pub. No. WO2013124867, each of which is herein incorporated by reference in their entirety.

b. Conjugates

In some embodiments, the compositions or formulations of the present disclosure comprise the polynucleotides described herein (e.g., a polynucleotide comprising a nucleotide sequence encoding a relaxin polypeptide) that is covalently linked to a carrier or targeting group, or including two encoding regions that together produce a fusion protein (e.g., bearing a targeting group and relaxin protein or peptide) as a conjugate. The conjugate can be a peptide that selectively directs the nanoparticle to neurons in a tissue or organism, or assists in crossing the blood-brain barrier.

The conjugates include a naturally occurring substance, such as a protein (e.g., human serum albumin (HSA), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The ligand can also be a recombinant or synthetic molecule, such as a synthetic polymer, e.g., a synthetic polyamino acid, an oligonucleotide (e.g., an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, the conjugate can function as a carrier for the polynucleotide disclosed herein. The conjugate can comprise a cationic polymer such as, but not limited to, polyamine, polylysine, polyalkylenimine, and polyethylenimine that can be grafted to with poly(ethylene glycol). Exemplary conjugates and their preparations are described in U.S. Pat. No. 6,586,524 and U.S. Pub. No. US20130211249, each of which herein is incorporated by reference in its entirety.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein. As a non-limiting example, the targeting group can be a glutathione receptor (GR)-binding conjugate for targeted delivery across the blood-central nervous system barrier as described in, e.g., U.S. Pub. No. US2013021661012 (herein incorporated by reference in its entirety).

In some embodiments, the conjugate can be a synergistic biomolecule-polymer conjugate, which comprises a long-acting continuous-release system to provide a greater therapeutic efficacy. The synergistic biomolecule-polymer conjugate can be those described in U.S. Pub. No. US20130195799. In some embodiments, the conjugate can be an aptamer conjugate as described in Intl. Pat. Pub. No. WO2012040524. In some embodiments, the conjugate can be an amine containing polymer conjugate as described in U.S. Pat. No. 8,507,653. Each of the references is herein incorporated by reference in its entirety. In some embodiments, the polynucleotides can be conjugated to SMARTT POLYMER TECHNOLOGY® (PHASERX®, Inc. Seattle, Wash.).

In some embodiments, the polynucleotides described herein are covalently conjugated to a cell penetrating polypeptide, which can also include a signal sequence or a targeting sequence. The conjugates can be designed to have increased stability, and/or increased cell transfection; and/or altered the biodistribution (e.g., targeted to specific tissues or cell types).

In some embodiments, the polynucleotides described herein can be conjugated to an agent to enhance delivery. In some embodiments, the agent can be a monomer or polymer such as a targeting monomer or a polymer having targeting blocks as described in Intl. Pub. No. WO2011062965. In some embodiments, the agent can be a transport agent covalently coupled to a polynucleotide as described in, e.g., U.S. Pat. Nos. 6,835,393 and 7,374,778. In some embodiments, the agent can be a membrane barrier transport enhancing agent such as those described in U.S. Pat. Nos. 7,737,108 and 8,003,129. Each of the references is herein incorporated by reference in its entirety.

Methods of Use

The polynucleotides, pharmaceutical compositions and formulations described above are used in the preparation, manufacture and therapeutic use of to treat and/or heart failure, and/or other disorders or conditions. In some embodiments, the polynucleotides, compositions and formulations of the invention are used to treat and/or prevent acute heart failure (AHF).

In some embodiments, the polynucleotides, pharmaceutical compositions and formulations of the invention are used in methods for increasing the levels of relaxin proteins in a subject in need thereof. For instance, one aspect of the invention provides a method of alleviating the symptoms of HF in a subject comprising the administration of a composition or formulation comprising a polynucleotide encoding a therapeutic protein to that subject (e.g, an mRNA encoding a functional component of a relaxin polypeptide).

In some embodiments, the administration of a composition or formulation comprising polynucleotide, pharmaceutical composition or formulation of the invention to a subject results in an increase in relaxin protein in cells to a level at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% higher than the level observed prior to the administration of the composition or formulation.

In some embodiments, the administration of the polynucleotide, pharmaceutical composition or formulation of the invention results in expression of relaxin protein in cells of the subject. In some embodiments, administering the polynucleotide, pharmaceutical composition or formulation of the invention results in an increase of relaxin protein activity in the subject. For example, in some embodiments, the polynucleotides of the present invention are used in methods of administering a composition or formulation comprising an mRNA encoding a relaxin polypeptide to a subject, wherein the method results in an increase of relaxin protein activity in at least some cells of a subject.

In some embodiments, the administration of a composition or formulation comprising an mRNA encoding a relaxin polypeptide to a subject results in an increase of relaxin protein activity in cells subject to a level at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% or more of the activity level expected in a normal subject, e.g., a human not suffering from heart disease.

In some embodiments, the administration of the polynucleotide, pharmaceutical composition or formulation of the invention results in expression of a relaxin protein in at least some of the cells of a subject that persists for a period of time sufficient to allow significant metabolism to occur.

In some embodiments, the expression of the encoded polypeptide is increased. In some embodiments, the polynucleotide increases relaxin protein expression levels in cells when introduced into those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% with respect to the relaxin protein expression level in the cells before the polypeptide is introduced in the cells.

Other aspects of the present disclosure relate to transplantation of cells containing polynucleotides to a mammalian subject. Administration of cells to mammalian subjects is known to those of ordinary skill in the art, and includes, but is not limited to, local implantation (e.g., topical or subcutaneous administration), organ delivery or systemic injection (e.g., intravenous injection or inhalation), and the formulation of cells in pharmaceutically acceptable carriers.

Compositions and Formulations for Use

Certain aspects of the invention are directed to compositions or formulations comprising any of the polynucleotides disclosed above.

In some embodiments, the composition or formulation comprises:
(i) a polynucleotide (e.g., a RNA, e.g., an mRNA) comprising a sequence-optimized nucleotide sequence (e.g., an ORF) encoding a relaxin polypeptide (e.g., the wild-type sequence, functional fragment, or variant thereof), wherein the polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the polynucleotide further comprises a miRNA binding site, e.g., a miRNA binding site that binds to miR-142 (e.g., a miR-142-3p or miR-142-5p binding site); and
(ii) a delivery agent comprising a LNP comprising, for instance, a lipid having the Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the relaxin polypeptide (% $U_{TM}$ or % $T_{TM}$), is between about 100% and about 150%.

In some embodiments, the polynucleotides, compositions or formulations above are used to treat and/or prevent a disease or disorder, e.g., acute heart failure.

Forms of Administration

The polynucleotides, pharmaceutical compositions and formulations of the invention described above can be administered by any route that results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electroosmosis, endocervical, endosinusial, endotracheal, extracorporeal, hemodialysis, infiltration, interstitial, intraabdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration that is then covered by a dressing that occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions can be administered in a way that allows them cross the blood-brain barrier, vascular barrier, or other epithelial barrier. In some embodiments, a formulation for a route of administration can include at least one inactive ingredient.

The polynucleotides of the present invention (e.g., a polynucleotide comprising a nucleotide sequence encoding a relaxin polypeptide or a functional fragment or variant thereof) can be delivered to a cell naked. As used herein in, "naked" refers to delivering polynucleotides free from agents that promote transfection. The naked polynucleotides can be delivered to the cell using routes of administration known in the art and described herein.

The polynucleotides of the present invention (e.g., a polynucleotide comprising a nucleotide sequence encoding a relaxin polypeptide or a functional fragment or variant thereof) can be formulated, using the methods described herein. The formulations can contain polynucleotides that can be modified and/or unmodified. The formulations can further include, but are not limited to, cell penetration agents, a pharmaceutically acceptable carrier, a delivery agent, a bioerodible or biocompatible polymer, a solvent, and a sustained-release delivery depot. The formulated polynucleotides can be delivered to the cell using routes of administration known in the art and described herein.

A pharmaceutical composition for parenteral administration can comprise at least one inactive ingredient. Any or none of the inactive ingredients used can have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions can be formulated according to the known art using suitable dispersing agents, wetting agents, and/or suspending agents. Sterile injectable preparations can be sterile injectable solutions, suspensions, and/or emulsions in nontoxic parenterally acceptable diluents and/or solvents, for example, as a solution in 1,3-butanediol. Among the acceptable vehicles and solvents that can be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation can also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions that can be dissolved or dispersed in sterile water or other sterile injectable medium prior to use.

Injectable formulations can be for direct injection into a region of a tissue, organ and/or subject. As a non-limiting example, a tissue, organ and/or subject can be directly injected a formulation by intramyocardial injection into the ischemic region. (See, e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This can be accomplished by the use of a liquid suspension of crystalline or amorphous material with poor water solubility. The rate of absorption of the drug then depends upon its rate of dissolution which, in turn, can depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly (orthoesters) and poly(anhydrides). Depot injectable formulations are prepared by entrapping the drug in liposomes or microemulsions that are compatible with body tissues.

Kits and Devices a. Kits

The invention provides a variety of kits for conveniently and/or effectively using the claimed nucleotides of the present invention. Typically, kits will comprise sufficient amounts and/or numbers of components to allow a user to perform multiple treatments of a subject(s) and/or to perform multiple experiments.

In one aspect, the present invention provides kits comprising the molecules (polynucleotides) of the invention.

Said kits can be for protein production, comprising a first polynucleotides comprising a translatable region. The kit can further comprise packaging and instructions and/or a delivery agent to form a formulation composition. The delivery agent can comprise a saline, a buffered solution, a lipidoid or any delivery agent disclosed herein.

In some embodiments, the buffer solution can include sodium chloride, calcium chloride, phosphate and/or EDTA. In another embodiment, the buffer solution can include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See, e.g., U.S. Pub. No. 20120258046; herein incorporated by reference in its entirety). In a further embodiment, the buffer solutions can be precipitated or it can be lyophilized. The amount of each component can be varied to enable consistent, reproducible higher concentration saline or simple buffer formulations. The components can also be varied in order to increase the stability of modified RNA in the buffer solution over a period of time and/or under a variety of conditions. In one aspect, the present invention provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present invention provides kits for protein production, comprising a polynucleotide comprising a translatable region, wherein the polynucleotide exhibits reduced degradation by a cellular nuclease, and packaging and instructions.

In one aspect, the present invention provides kits for protein production, comprising a polynucleotide comprising a translatable region, wherein the polynucleotide exhibits reduced degradation by a cellular nuclease, and a mammalian cell suitable for translation of the translatable region of the first nucleic acid.

b. Devices

The present invention provides for devices that can incorporate polynucleotides that encode polypeptides of interest. These devices contain in a stable formulation the reagents to synthesize a polynucleotide in a formulation available to be immediately delivered to a subject in need thereof, such as a human patient.

Devices for administration can be employed to deliver the polynucleotides of the present invention according to single, multi- or split-dosing regimens taught herein. Such devices are taught in, for example, International Application Publ. No. WO2013151666, the contents of which are incorporated herein by reference in their entirety.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

According to the present invention, these multi-administration devices can be utilized to deliver the single, multi- or split doses contemplated herein. Such devices are taught for example in, International Application Publ. No. WO2013151666, the contents of which are incorporated herein by reference in their entirety.

In some embodiments, the polynucleotide is administered subcutaneously or intramuscularly via at least 3 needles to three different, optionally adjacent, sites simultaneously, or within a 60 minute period (e.g., administration to 4, 5, 6, 7, 8, 9, or 10 sites simultaneously or within a 60 minute period).

c. Methods and Devices Utilizing Catheters and/or Lumens

Methods and devices using catheters and lumens can be employed to administer the polynucleotides of the present invention on a single, multi- or split dosing schedule. Such methods and devices are described in International Application Publication No. WO2013151666, the contents of which are incorporated herein by reference in their entirety.

d. Methods and Devices Utilizing Electrical Current

Methods and devices utilizing electric current can be employed to deliver the polynucleotides of the present invention according to the single, multi- or split dosing regimens taught herein. Such methods and devices are described in International Application Publication No. WO2013151666, the contents of which are incorporated herein by reference in their entirety.

Definitions

In order that the present disclosure can be more readily understood, certain terms are first defined. As used in this application, except as otherwise expressly provided herein, each of the following terms shall have the meaning set forth below. Additional definitions are set forth throughout the application.

The invention includes embodiments in which exactly one member of the group is present in, employed in, or otherwise relevant to a given product or process. The invention includes embodiments in which more than one, or all of the group members are present in, employed in, or otherwise relevant to a given product or process.

In this specification and the appended claims, the singular forms "a", "an" and "the" include plural referents unless the context clearly dictates otherwise. The terms "a" (or "an"), as well as the terms "one or more," and "at least one" can be used interchangeably herein. In certain aspects, the term "a" or "an" means "single." In other aspects, the term "a" or "an" includes "two or more" or "multiple."

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Wherever aspects are described herein with the language "comprising," otherwise analogous aspects described in terms of "consisting of" and/or "consisting essentially of" are also provided.

Units, prefixes, and symbols are denoted in their Système International de Unites (SI) accepted form. Numeric ranges are inclusive of the numbers defining the range. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value is explicitly recited, it is to be understood that values which are about the same quantity or amount as the recited value are also within the scope of the invention. Where a combination is disclosed, each subcombination of the elements of that combination is also specifically disclosed and is within the scope of the invention. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Nucleotides are referred to by their commonly accepted single-letter codes. Unless otherwise indicated, nucleic acids are written left to right in 5' to 3' orientation. Nucleobases are referred to herein by their commonly known one-letter symbols recommended by the IUPAC-IUB Biochemical Nomenclature Commission. Accordingly, A represents adenine, C represents cytosine, G represents guanine, T represents thymine, U represents uracil.

Amino acids are referred to herein by either their commonly known three letter symbols or by the one-letter symbols recommended by the IUPAC-IUB Biochemical Nomenclature Commission. Unless otherwise indicated, amino acid sequences are written left to right in amino to carboxy orientation.

About: The term "about" as used in connection with a numerical value throughout the specification and the claims denotes an interval of accuracy, familiar and acceptable to a person skilled in the art, such interval of accuracy is ±10%.

Where ranges are given, endpoints are included. Furthermore, unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

Administered in combination: As used herein, the term "administered in combination" or "combined administration" means that two or more agents are administered to a subject at the same time or within an interval such that there can be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Amino acid substitution: The term "amino acid substitution" refers to replacing an amino acid residue present in a parent or reference sequence (e.g., a wild type relaxin sequence) with another amino acid residue. An amino acid can be substituted in a parent or reference sequence (e.g., a wild type relaxin polypeptide sequence), for example, via chemical peptide synthesis or through recombinant methods known in the art. Accordingly, a reference to a "substitution at position X" refers to the substitution of an amino acid present at position X with an alternative amino acid residue. In some aspects, substitution patterns can be described according to the schema AnY, wherein A is the single letter code corresponding to the amino acid naturally or originally present at position n, and Y is the substituting amino acid residue. In other aspects, substitution patterns can be described according to the schema An(YZ), wherein A is the single letter code corresponding to the amino acid residue substituting the amino acid naturally or originally present at position X, and Y and Z are alternative substituting amino acid residue, i.e., In the context of the present disclosure, substitutions (even when they referred to as amino acid substitution) are conducted at the nucleic acid level, i.e., substituting an amino acid residue with an alternative amino acid residue is conducted by substituting the codon encoding the first amino acid with a codon encoding the second amino acid.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately," as applied to one or more values of interest, refers to a value that is similar to a stated reference value. In certain embodiments, the term "approximately" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein with respect to a disease, the term "associated with" means that the symptom, measurement, characteristic, or status in question is linked to the diagnosis, development, presence, or progression of that disease. As association can, but need not, be causatively linked to the disease.

When used with respect to two or more moieties, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It can also suggest ionic or hydrogen bonding or a hybridization based connectivity sufficiently stable such that the "associated" entities remain physically associated.

Bifunctional: As used herein, the term "bifunctional" refers to any substance, molecule or moiety that is capable of or maintains at least two functions. The functions can affect the same outcome or a different outcome. The structure that produces the function can be the same or different. For example, bifunctional modified RNAs of the present invention can encode a relaxin peptide (a first function) while those nucleosides that comprise the encoding RNA are, in and of themselves, capable of extending the half-life of the RNA (second function). In this example, delivery of the bifunctional modified RNA to a subject suffering from a protein defficiency would produce not only a peptide or protein molecule that can ameliorate or treat a disease or conditions, but would also maintain a population modified RNA present in the subject for a prolonged period of time. In other aspects, a bifunction modified mRNA can be a chimeric or quimeric molecule comprising, for example, an RNA encoding a relaxin peptide (a first function) and a second protein either fused to first protein or co-expressed with the first protein.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present invention can be considered biologically active if even a portion of the polynucleotide is biologically active or mimics an activity considered biologically relevant.

Chimera: As used herein, "chimera" is an entity having two or more incongruous or heterogeneous parts or regions. For example, a chimeric molecule can comprise a first part comprising a relaxin polypeptide, and a second part (e.g., genetically fused to the first part) comprising a second relaxin protein (e.g., a protein with a distinct enzymatic activity, an antigen binding moiety, or a moiety capable of extending the plasma half life of relaxin, for example, an Fc region of an antibody).

Sequence Optimization: The term "sequence optimization" refers to a process or series of processes by which nucleobases in a reference nucleic acid sequence are replaced with alternative nucleobases, resulting in a nucleic acid sequence with improved properties, e.g., improved protein expression or decreased immunogenicity.

In general, the goal in sequence optimization is to produce a synonymous nucleotide sequence than encodes the same polypeptide sequence encoded by the reference nucleotide sequence. Thus, there are no amino acid substitutions (as a result of codon optimization) in the polypeptide encoded by the codon optimized nucleotide sequence with respect to the polypeptide encoded by the reference nucleotide sequence.

Codon substitution: The terms "codon substitution" or "codon replacement" in the context of sequence optimization refer to replacing a codon present in a reference nucleic acid sequence with another codon. A codon can be substituted in a reference nucleic acid sequence, for example, via chemical peptide synthesis or through recombinant methods known in the art. Accordingly, references to a "substitution" or "replacement" at a certain location in a nucleic acid sequence (e.g., an mRNA) or within a certain region or subsequence of a nucleic acid sequence (e.g., an mRNA) refer to the substitution of a codon at such location or region with an alternative codon.

As used herein, the terms "coding region" and "region encoding" and grammatical variants thereof, refer to an Open Reading Frame (ORF) in a polynucleotide that upon expression yields a polypeptide or protein.

Compound: As used herein, the term "compound," is meant to include all stereoisomers and isotopes of the structure depicted. As used herein, the term "stereoisomer" means any geometric isomer (e.g., cis- and trans-isomer), enantiomer, or diastereomer of a compound. The present disclosure encompasses any and all stereoisomers of the compounds described herein, including stereomerically pure forms (e.g., geometrically pure, enantiomerically pure, or diastereomerically pure) and enantiomeric and stereoisomeric mixtures, e.g., racemates. Enantiomeric and stereomeric mixtures of compounds and means of resolving them into their component enantiomers or stereoisomers are well-known. "Isotopes" refers to atoms having the same atomic number but different mass numbers resulting from a different number of neutrons in the nuclei. For example, isotopes of hydrogen include tritium and deuterium. Further, a compound, salt, or complex of the present disclosure can be prepared in combination with solvent or water molecules to form solvates and hydrates by routine methods.

Contacting: As used herein, the term "contacting" means establishing a physical connection between two or more entities. For example, contacting a mammalian cell with a nanoparticle composition means that the mammalian cell and a nanoparticle are made to share a physical connection. Methods of contacting cells with external entities both in vivo and ex vivo are well known in the biological arts. For example, contacting a nanoparticle composition and a mammalian cell disposed within a mammal can be performed by varied routes of administration (e.g., intravenous, intramuscular, intradermal, and subcutaneous) and can involve varied amounts of nanoparticle compositions. Moreover, more than one mammalian cell can be contacted by a nanoparticle composition.

Conservative amino acid substitution: A "conservative amino acid substitution" is one in which the amino acid residue in a protein sequence is replaced with an amino acid residue having a similar side chain. Families of amino acid residues having similar side chains have been defined in the art, including basic side chains (e.g., lysine, arginine, or histidine), acidic side chains (e.g., aspartic acid or glutamic acid), uncharged polar side chains (e.g., glycine, asparagine, glutamine, serine, threonine, tyrosine, or cysteine), nonpolar side chains (e.g., alanine, valine, leucine, isoleucine, proline, phenylalanine, methionine, or tryptophan), beta-branched side chains (e.g., threonine, valine, isoleucine) and aromatic side chains (e.g., tyrosine, phenylalanine, tryptophan, or histidine). Thus, if an amino acid in a polypeptide is replaced with another amino acid from the same side chain family, the amino acid substitution is considered to be conservative. In another aspect, a string of amino acids can be conservatively replaced with a structurally similar string that differs in order and/or composition of side chain family members.

Non-conservative amino acid substitution: Non-conservative amino acid substitutions include those in which (i) a residue having an electropositive side chain (e.g., Arg, His or Lys) is substituted for, or by, an electronegative residue (e.g., Glu or Asp), (ii) a hydrophilic residue (e.g., Ser or Thr) is substituted for, or by, a hydrophobic residue (e.g., Ala, Leu, Ile, Phe or Val), (iii) a cysteine or proline is substituted for, or by, any other residue, or (iv) a residue having a bulky hydrophobic or aromatic side chain (e.g., Val, His, Ile or Trp) is substituted for, or by, one having a smaller side chain (e.g., Ala or Ser) or no side chain (e.g., Gly).

Other amino acid substitutions can be readily identified by workers of ordinary skill. For example, for the amino acid alanine, a substitution can be taken from any one of D-alanine, glycine, beta-alanine, L-cysteine and D-cysteine. For lysine, a replacement can be any one of D-lysine, arginine, D-arginine, homo-arginine, methionine, D-methionine, ornithine, or D-ornithine. Generally, substitutions in functionally important regions that can be expected to induce changes in the properties of isolated polypeptides are those in which (i) a polar residue, e.g., serine or threonine, is substituted for (or by) a hydrophobic residue, e.g., leucine, isoleucine, phenylalanine, or alanine; (ii) a cysteine residue is substituted for (or by) any other residue; (iii) a residue having an electropositive side chain, e.g., lysine, arginine or histidine, is substituted for (or by) a residue having an electronegative side chain, e.g., glutamic acid or aspartic acid; or (iv) a residue having a bulky side chain, e.g., phenylalanine, is substituted for (or by) one not having such a side chain, e.g., glycine. The likelihood that one of the foregoing non-conservative substitutions can alter functional properties of the protein is also correlated to the position of the substitution with respect to functionally important regions of the protein: some non-conservative substitutions can accordingly have little or no effect on biological properties.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence can apply to the entire length of an polynucleotide or polypeptide or can apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present invention can be single units or multimers or comprise one or more components of a complex or higher order structure.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivering: As used herein, the term "delivering" means providing an entity to a destination. For example, delivering a polynucleotide to a subject can involve administering a nanoparticle composition including the polynucleotide to the subject (e.g., by an intravenous, intramuscular, intradermal, or subcutaneous route). Administration of a nanoparticle composition to a mammal or mammalian cell can involve contacting one or more cells with the nanoparticle composition.

Delivery Agent: As used herein, "delivery agent" refers to any substance that facilitates, at least in part, the in vivo, in vitro, or ex vivo delivery of a polynucleotide to targeted cells.

Destabilized: As used herein, the term "destable," "destabilize," or "destabilizing region" means a region or molecule that is less stable than a starting, wild-type or native form of the same region or molecule.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Domain: As used herein, when referring to polypeptides, the term "domain" refers to a motif of a polypeptide having one or more identifiable structural or functional characteristics or properties (e.g., binding capacity, serving as a site for protein-protein interactions).

Dosing regimen: As used herein, a "dosing regimen" or a "dosing regimen" is a schedule of administration or physician determined regimen of treatment, prophylaxis, or palliative care.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats a protein deficiency (e.g., a relaxin deficiency), an effective amount of an agent is, for example, an amount of mRNA expressing sufficient relaxin to ameliorate, reduce, eliminate, or prevent the signs or symptoms associated with the relaxin deficiency, as compared to the severity of the symptom observed without administration of the agent. The term "effective amount" can be used interchangeably with "effective dose," "therapeutically effective amount," or "therapeutically effective dose."

Enantiomer: As used herein, the term "enantiomer" means each individual optically active form of a compound of the invention, having an optical purity or enantiomeric excess (as determined by methods standard in the art) of at least 80% (i.e., at least 90% of one enantiomer and at most 10% of the other enantiomer), at least 90%, or at least 98%.

Encapsulate: As used herein, the term "encapsulate" means to enclose, surround or encase.

Encapsulation Efficiency: As used herein, "encapsulation efficiency" refers to the amount of a polynucleotide that becomes part of a nanoparticle composition, relative to the initial total amount of polynucleotide used in the preparation of a nanoparticle composition. For example, if 97 mg of polynucleotide are encapsulated in a nanoparticle composition out of a total 100 mg of polynucleotide initially provided to the composition, the encapsulation efficiency can be given as 97%. As used herein, "encapsulation" can refer to complete, substantial, or partial enclosure, confinement, surrounding, or encasement.

Encoded protein cleavage signal: As used herein, "encoded protein cleavage signal" refers to the nucleotide sequence that encodes a protein cleavage signal.

Engineered: As used herein, embodiments of the invention are "engineered" when they are designed to have a feature or property, whether structural or chemical, that varies from a starting point, wild type or native molecule.

Enhanced Delivery: As used herein, the term "enhanced delivery" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to the level of delivery of a polynucleotide by a control nanoparticle to a target tissue of interest (e.g., MC3, KC2, or DLinDMA). The level of delivery of a nanoparticle to a particular tissue can be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. It will be understood that the enhanced delivery of a nanoparticle to a target tissue need not be determined in a subject being treated, it can be determined in a surrogate such as an animal model (e.g., a rat model).

Exosome: As used herein, "exosome" is a vesicle secreted by mammalian cells or a complex involved in RNA degradation.

Expression: As used herein, "expression" of a nucleic acid sequence refers to one or more of the following events: (1) production of an mRNA template from a DNA sequence (e.g., by transcription); (2) processing of an mRNA transcript (e.g., by splicing, editing, 5' cap formation, and/or 3' end processing); (3) translation of an mRNA into a polypeptide or protein; and (4) post-translational modification of a polypeptide or protein.

Ex Vivo: As used herein, the term "ex vivo" refers to events that occur outside of an organism (e.g., animal, plant, or microbe or cell or tissue thereof). Ex vivo events can take place in an environment minimally altered from a natural (e.g., in vivo) environment.

Feature: As used herein, a "feature" refers to a characteristic, a property, or a distinctive element. When referring to polypeptides, "features" are defined as distinct amino acid sequence-based components of a molecule. Features of the polypeptides encoded by the polynucleotides of the present invention include surface manifestations, local conformational shape, folds, loops, half-loops, domains, half-domains, sites, termini or any combination thereof.

Formulation: As used herein, a "formulation" includes at least a polynucleotide and one or more of a carrier, an excipient, and a delivery agent.

Fragment: A "fragment," as used herein, refers to a portion. For example, fragments of proteins can comprise polypeptides obtained by digesting full-length protein isolated from cultured cells. In some embodiments, a fragment is a subsequences of a full length protein wherein N-terminal, and/or C-terminal, and/or internal subsequences have been deleted. In some preferred aspects of the present invention, the fragments of a protein of the present invention are functional fragments.

Functional: As used herein, a "functional" biological molecule is a biological molecule in a form in which it exhibits a property and/or activity by which it is characterized. Thus, a functional fragment of a polynucleotide of the present invention is a polynucleotide capable of expressing a functional relaxin fragment. As used herein, a functional fragment of a relaxin refers to a fragment of wild type relaxin (i.e., a fragment of any of its naturally occurring isoforms), or a mutant or variant thereof, wherein the fragment retains a least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95% of the biological activity of the corresponding full length protein.

Helper Lipid: As used herein, the term "helper lipid" refers to a compound or molecule that includes a lipidic moiety (for insertion into a lipid layer, e.g., lipid bilayer) and a polar moiety (for interaction with physiologic solution at the surface of the lipid layer). Typically, the helper lipid is a phospholipid. A function of the helper lipid is to "complement" the amino lipid and increase the fusogenicity of the bilayer and/or to help facilitate endosomal escape, e.g., of nucleic acid delivered to cells. Helper lipids are also believed to be a key structural component to the surface of the LNP.

Homology: As used herein, the term "homology" refers to the overall relatedness between polymeric molecules, e.g. between nucleic acid molecules (e.g. DNA molecules and/or RNA molecules) and/or between polypeptide molecules. Generally, the term "homology" implies an evolutionary relationship between two molecules. Thus, two molecules that are homologous will have a common evolutionary ancestor. In the context of the present invention, the term homology encompasses both to identity and similarity.

In some embodiments, polymeric molecules are considered to be "homologous" to one another if at least 25%, 30%, 35%, 40%, 45%, 50%, 55%, 60%, 65%, 70%, 75%, 80%, 85%, 90%, 95%, or 99% of the monomers in the molecule are identical (exactly the same monomer) or are similar (conservative substitutions). The term "homologous" necessarily refers to a comparison between at least two sequences (polynucleotide or polypeptide sequences).

Identity: As used herein, the term "identity" refers to the overall monomer conservation between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. When comparing DNA and RNA, thymine (T) and uracil (U) can be considered equivalent.

One suitable program to determine percent sequence identity is bl2seq, part of the BLAST suite of program available from the U.S. Government's National 5 Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) on the world wide web at ebi.ac.uk/Tools/psa.

Sequence alignments can be conducted using methods known in the art such as MAFFT, Clustal (ClustalW, Clustal X or Clustal Omega), MUSCLE, etc.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

In certain aspects, the percentage identity "% ID" of a first amino acid sequence (or nucleic acid sequence) to a second amino acid sequence (or nucleic acid sequence) is calculated as % ID=100×(Y/Z), where Y is the number of amino acid residues (or nucleobases) scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be higher than the percent identity of the second sequence to the first sequence.

One skilled in the art will appreciate that the generation of a sequence alignment for the calculation of a percent sequence identity is not limited to binary sequence-sequence comparisons exclusively driven by primary sequence data. It will also be appreciated that sequence alignments can be generated by integrating sequence data with data from heterogeneous sources such as structural data (e.g., crystallographic protein structures), functional data (e.g., location of mutations), or phylogenetic data.

A suitable program that integrates heterogeneous data to generate a multiple sequence alignment is T-Coffee, available on the world wide web at tcoffee.org, and alternatively available, e.g., from the EBI. It will also be appreciated that the final alignment used to calculate percent sequence identity can be curated either automatically or manually.

Immune response: The term "immune response" refers to the action of, for example, lymphocytes, antigen presenting cells, phagocytic cells, granulocytes, and soluble macromolecules produced by the above cells or the liver (including antibodies, cytokines, and complement) that results in selective damage to, destruction of, or elimination from the human body of invading pathogens, cells or tissues infected with pathogens, cancerous cells, or, in cases of autoimmunity or pathological inflammation, normal human cells or tissues. In some cases, the administration of a nanoparticle comprising a lipid component and an encapsulated therapeutic agent can trigger an immune response, which can be caused by (i) the encapsulated therapeutic agent (e.g., an mRNA), (ii) the expression product of such encapsulated therapeutic agent (e.g., a polypeptide encoded by the mRNA), (iii) the lipid component of the nanoparticle, or (iv) a combination thereof.

Inflammatory response: "Inflammatory response" refers to immune responses involving specific and non-specific defense systems. A specific defense system reaction is a specific immune system reaction to an antigen. Examples of specific defense system reactions include antibody responses. A non-specific defense system reaction is an inflammatory response mediated by leukocytes generally incapable of immunological memory, e.g., macrophages, eosinophils and neutrophils. In some aspects, an immune response includes the secretion of inflammatory cytokines, resulting in elevated inflammatory cytokine levels.

Inflammatory cytokines: The term "inflammatory cytokine" refers to cytokines that are elevated in an inflammatory response. Examples of inflammatory cytokines include interleukin-6 (IL-6), CXCL1 (chemokine (C-X-C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-12 (IL-12), interleukin-13 (Il-13), interferon α (IFN-α), etc.

In Vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In Vivo: As used herein, the term "in vivo" refers to events that occur within an organism (e.g., animal, plant, or microbe or cell or tissue thereof).

Insertional and deletional variants: "Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid. "Deletional variants" when referring to polypeptides are those with one or more amino acids in the native or starting amino acid sequence removed. Ordinarily, deletional variants will have one or more amino acids deleted in a particular region of the molecule.

Intact: As used herein, in the context of a polypeptide, the term "intact" means retaining an amino acid corresponding to the wild type protein, e.g., not mutating or substituting the wild type amino acid. Conversely, in the context of a nucleic acid, the term "intact" means retaining a nucleobase corresponding to the wild type nucleic acid, e.g., not mutating or substituting the wild type nucleobase.

Ionizable amino lipid: The term "ionizable amino lipid" includes those lipids having one, two, three, or more fatty acid or fatty alkyl chains and a pH-titratable amino head group (e.g., an alkylamino or dialkylamino head group). An ionizable amino lipid is typically protonated (i.e., positively charged) at a pH below the pKa of the amino head group and is substantially not charged at a pH above the pKa. Such ionizable amino lipids include, but are not limited to DLin-MC3-DMA (MC3) and (13Z,165Z)—N,N-dimethyl-3-nonydocosa-13-16-dien-1-amine (L608).

Isolated: As used herein, the term "isolated" refers to a substance or entity that has been separated from at least some of the components with which it was associated (whether in nature or in an experimental setting). Isolated substances (e.g., polynucleotides or polypeptides) can have varying levels of purity in reference to the substances from which they have been isolated. Isolated substances and/or entities can be separated from at least about 10%, about 20%, about 30%, about 40%, about 50%, about 60%, about 70%, about 80%, about 90%, or more of the other components with which they were initially associated. In some embodiments, isolated substances are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof.

A polynucleotide, vector, polypeptide, cell, or any composition disclosed herein which is "isolated" is a polynucleotide, vector, polypeptide, cell, or composition which is in a form not found in nature. Isolated polynucleotides, vectors, polypeptides, or compositions include those which have been purified to a degree that they are no longer in a form in which they are found in nature. In some aspects, a polynucleotide, vector, polypeptide, or composition which is isolated is substantially pure.

Isomer: As used herein, the term "isomer" means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker can be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleotides) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Methods of Administration: As used herein, "methods of administration" can include intravenous, intramuscular, intradermal, subcutaneous, or other methods of delivering a composition to a subject. A method of administration can be selected to target delivery (e.g., to specifically deliver) to a specific region or system of a body.

Modified: As used herein "modified" refers to a changed state or structure of a molecule of the invention. Molecules can be modified in many ways including chemically, structurally, and functionally. In some embodiments, the mRNA molecules of the present invention are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Nanoparticle Composition: As used herein, a "nanoparticle composition" is a composition comprising one or more lipids. Nanoparticle compositions are typically sized on the order of micrometers or smaller and can include a lipid bilayer. Nanoparticle compositions encompass lipid nanoparticles (LNPs), liposomes (e.g., lipid vesicles), and lipoplexes. For example, a nanoparticle composition can be a liposome having a lipid bilayer with a diameter of 500 nm or less.

Naturally occurring: As used herein, "naturally occurring" means existing in nature without artificial aid.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Nucleic acid sequence: The terms "nucleic acid sequence," "nucleotide sequence," or "polynucleotide sequence" are used interchangeably and refer to a contiguous nucleic acid sequence. The sequence can be either single stranded or double stranded DNA or RNA, e.g., an mRNA.

The term "nucleic acid," in its broadest sense, includes any compound and/or substance that comprises a polymer of nucleotides. These polymers are often referred to as polynucleotides. Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

The phrase "nucleotide sequence encoding" refers to the nucleic acid (e.g., an mRNA or DNA molecule) coding sequence which encodes a polypeptide. The coding sequence can further include initiation and termination signals operably linked to regulatory elements including a promoter and polyadenylation signal capable of directing expression in the cells of an individual or mammal to which the nucleic acid is administered. The coding sequence can further include sequences that encode signal peptides.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g., alkyl) per se is optional.

Part: As used herein, a "part" or "region" of a polynucleotide is defined as any portion of the polynucleotide that is less than the entire length of the polynucleotide.

Patient: As used herein, "patient" refers to a subject who can seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms that are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients can include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspensing or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound that contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two;

generally, nonaqueous media like ether, ethyl acetate, ethanol, isopropanol, or acetonitrile are used. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates can be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polynucleotide: The term "polynucleotide" as used herein refers to polymers of nucleotides of any length, including ribonucleotides, deoxyribonucleotides, analogs thereof, or mixtures thereof. This term refers to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the term "polynucleotide" includes polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing normucleotidic backbones, for example, polyamide (e.g., peptide nucleic acids "PNAs") and polymorpholino polymers, and other synthetic sequence-specific nucleic acid polymers providing that the polymers contain nucleobases in a configuration which allows for base pairing and base stacking, such as is found in DNA and RNA. In particular aspects, the polynucleotide comprises an mRNA. In other aspect, the mRNA is a synthetic mRNA. In some aspects, the synthetic mRNA comprises at least one unnatural nucleobase. In some aspects, all nucleobases of a certain class have been replaced with unnatural nucleobases (e.g., all uridines in a polynucleotide disclosed herein can be replaced with an unnatural nucleobase, e.g., 5-methoxyuridine). In some aspects, the polynucleotide (e.g., a synthetic RNA or a synthetic DNA) comprises only natural nucleobases, i.e., A (adenosine), G (guanosine), C (cytidine), and T (thymidine) in the case of a synthetic DNA, or A, C, G, and U (uridine) in the case of a synthetic RNA.

The skilled artisan will appreciate that the T bases in the codon maps disclosed herein are present in DNA, whereas the T bases would be replaced by U bases in corresponding RNAs. For example, a codon-nucleotide sequence disclosed herein in DNA form, e.g., a vector or an in-vitro translation (IVT) template, would have its T bases transcribed as U based in its corresponding transcribed mRNA. In this respect, both codon-optimized DNA sequences (comprising T) and their corresponding mRNA sequences (comprising U) are considered codon-optimized nucleotide sequence of the present invention. A skilled artisan would also understand that equivalent codon-maps can be generated by replaced one or more bases with non-natural bases. Thus, e.g., a TTC codon (DNA map) would correspond to a UUC codon (RNA map), which in turn would correspond to a ΨΨC codon (RNA map in which U has been replaced with pseudouridine).

Standard A-T and G-C base pairs form under conditions which allow the formation of hydrogen bonds between the N3-H and C4-oxy of thymidine and the N1 and C6-NH2, respectively, of adenosine and between the C2-oxy, N3 and C4-NH2, of cytidine and the C2-NH2, N'—H and C6-oxy, respectively, of guanosine. Thus, for example, guanosine (2-amino-6-oxy-9-β-D-ribofuranosyl-purine) can be modified to form isoguanosine (2-oxy-6-amino-9-β-D-ribofuranosyl-purine). Such modification results in a nucleoside base which will no longer effectively form a standard base pair with cytosine. However, modification of cytosine (1-β-D-ribofuranosyl-2-oxy-4-amino-pyrimidine) to form isocytosine (1-β-D-ribofuranosyl-2-amino-4-oxy-pyrimidine-) results in a modified nucleotide which will not effectively base pair with guanosine but will form a base pair with isoguanosine (U.S. Pat. No. 5,681,702 to Collins et al.). Isocytosine is available from Sigma Chemical Co. (St. Louis, Mo.); isocytidine can be prepared by the method described by Switzer et al. (1993) Biochemistry 32:10489-10496 and references cited therein; 2'-deoxy-5-methyl-isocytidine can be prepared by the method of Tor et al., 1993, J. Am. Chem. Soc. 115:4461-4467 and references cited therein; and isoguanine nucleotides can be prepared using the method described by Switzer et al., 1993, supra, and Mantsch et al., 1993, Biochem. 14:5593-5601, or by the method described in U.S. Pat. No. 5,780,610 to Collins et al. Other nonnatural base pairs can be synthesized by the method described in Piccirilli et al., 1990, Nature 343:33-37, for the synthesis of 2,6-diaminopyrimidine and its complement (1-methylpyrazolo-[4,3]pyrimidine-5,7-(4H,6H)-dione. Other such modified nucleotide units which form unique base pairs are known, such as those described in Leach et al. (1992) J. Am. Chem. Soc. 114:3675-3683 and Switzer et al., supra.

Polypeptide: The terms "polypeptide," "peptide," and "protein" are used interchangeably herein to refer to polymers of amino acids of any length. The polymer can comprise modified amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids such as homocysteine, ornithine, p-acetylphenylalanine, D-amino acids, and creatine), as well as other modifications known in the art.

The term, as used herein, refers to proteins, polypeptides, and peptides of any size, structure, or function. Polypeptides include encoded polynucleotide products, naturally occurring polypeptides, synthetic polypeptides, homologs, orthologs, paralogs, fragments and other equivalents, variants, and analogs of the foregoing. A polypeptide can be a monomer or can be a multi-molecular complex such as a dimer, trimer or tetramer. They can also comprise single chain or multichain polypeptides. Most commonly disulfide linkages are found in multichain polypeptides. The term polypeptide can also apply to amino acid polymers in which one or more amino acid residues are an artificial chemical analogue of a corresponding naturally occurring amino acid. In some embodiments, a "peptide" can be less than or equal to 50 amino acids long, e.g., about 5, 10, 15, 20, 25, 30, 35, 40, 45, or 50 amino acids long.

Polypeptide variant: As used herein, the term "polypeptide variant" refers to molecules that differ in their amino acid sequence from a native or reference sequence. The amino acid sequence variants can possess substitutions, deletions, and/or insertions at certain positions within the amino acid sequence, as compared to a native or reference sequence. Ordinarily, variants will possess at least about 50% identity, at least about 60% identity, at least about 70% identity, at least about 80% identity, at least about 90% identity, at least about 95% identity, at least about 99% identity to a native or reference sequence. In some embodiments, they will be at least about 80%, or at least about 90% identical to a native or reference sequence.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc. divided by the measure in the body fluid.

Preventing: As used herein, the term "preventing" refers to partially or completely delaying onset of an infection, disease, disorder and/or condition; partially or completely delaying onset of one or more signs or symptoms, features, or clinical manifestations of a particular infection, disease, disorder, and/or condition; partially or completely delaying onset of one or more signs or symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune prophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine ($\psi$) refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3$ $\psi$), and 2'-O-methyl-pseudouridine ($\psi$m).

Purified: As used herein, "purify," "purified," "purification" means to make substantially pure or clear from unwanted components, material defilement, admixture or imperfection.

Reference Nucleic Acid Sequence: The term "reference nucleic acid sequence" or "reference nucleic acid" or "reference nucleotide sequence" or "reference sequence" refers to a starting nucleic acid sequence (e.g., a RNA, e.g., an mRNA sequence) that can be sequence optimized. In some embodiments, the reference nucleic acid sequence is a wild type nucleic acid sequence, a fragment or a variant thereof. In some embodiments, the reference nucleic acid sequence is a previously sequence optimized nucleic acid sequence.

Salts: In some aspects, the pharmaceutical composition for intratumoral delivery disclosed herein and comprises salts of some of their lipid constituents. The term "salt" includes any anionic and cationic complex. Non-limiting examples of anions include inorganic and organic anions, e.g., fluoride, chloride, bromide, iodide, oxalate (e.g., hemioxalate), phosphate, phosphonate, hydrogen phosphate, dihydrogen phosphate, oxide, carbonate, bicarbonate, nitrate, nitrite, nitride, bisulfite, sulfide, sulfite, bisulfate, sulfate, thiosulfate, hydrogen sulfate, borate, formate, acetate, benzoate, citrate, tartrate, lactate, acrylate, polyacrylate, fumarate, maleate, itaconate, glycolate, gluconate, malate, mandelate, tiglate, ascorbate, salicylate, polymethacrylate, perchlorate, chlorate, chlorite, hypochlorite, bromate, hypobromite, iodate, an alkylsulfonate, an arylsulfonate, arsenate, arsenite, chromate, dichromate, cyanide, cyanate, thiocyanate, hydroxide, peroxide, permanganate, and mixtures thereof.

Sample: As used herein, the term "sample" or "biological sample" refers to a subset of its tissues, cells or component parts (e.g., body fluids, including but not limited to blood, mucus, lymphatic fluid, synovial fluid, cerebrospinal fluid, saliva, amniotic fluid, amniotic cord blood, urine, vaginal fluid and semen). A sample further can include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which can contain cellular components, such as proteins or nucleic acid molecule.

Signal Sequence: As used herein, the phrases "signal sequence," "signal peptide," and "transit peptide" are used interchangeably and refer to a sequence that can direct the transport or localization of a protein to a certain organelle, cell compartment, or extracellular export. The term encompasses both the signal sequence polypeptide and the nucleic acid sequence encoding the signal sequence. Thus, references to a signal sequence in the context of a nucleic acid refer in fact to the nucleic acid sequence encoding the signal sequence polypeptide.

Signal transduction pathway: A "signal transduction pathway" refers to the biochemical relationship between a variety of signal transduction molecules that play a role in the transmission of a signal from one portion of a cell to another portion of a cell. As used herein, the phrase "cell surface receptor" includes, for example, molecules and complexes of molecules capable of receiving a signal and the transmission of such a signal across the plasma membrane of a cell.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Single unit dose: As used herein, a "single unit dose" is a dose of any therapeutic administered in one dose/at one time/single route/single point of contact, i.e., single administration event.

Split dose: As used herein, a "split dose" is the division of single unit dose or total daily dose into two or more doses.

Specific delivery: As used herein, the term "specific delivery," "specifically deliver," or "specifically delivering" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to an off-target tissue (e.g., mammalian spleen). The level of delivery of a nanoparticle to a particular tissue can be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. For example, for renovascular targeting, a polynucleotide is specifically provided to a mammalian kidney as compared to the liver and spleen if 1.5, 2-fold, 3-fold, 5-fold, 10-fold, 15 fold, or 20 fold more polynucleotide per 1 g of tissue is delivered to a kidney compared to that delivered to the liver or spleen following systemic administration of the polynucleotide. It will be understood that the ability of a nanoparticle to specifically deliver to a target tissue need not be determined in a subject being treated, it can be determined in a surrogate such as an animal model (e.g., a rat model).

Stable: As used herein "stable" refers to a compound that is sufficiently robust to survive isolation to a useful degree of purity from a reaction mixture, and in some cases capable of formulation into an efficacious therapeutic agent.

Stabilized: As used herein, the term "stabilize," "stabilized," "stabilized region" means to make or become stable.

Stereoisomer: As used herein, the term "stereoisomer" refers to all possible different isomeric as well as conformational forms that a compound can possess (e.g., a compound of any formula described herein), in particular all possible stereochemically and conformationally isomeric forms, all diastereomers, enantiomers and/or conformers of the basic molecular structure. Some compounds of the present invention can exist in different tautomeric forms, all of the latter being included within the scope of the present invention.

Subject: By "subject" or "individual" or "animal" or "patient" or "mammal," is meant any subject, particularly a mammalian subject, for whom diagnosis, prognosis, or therapy is desired. Mammalian subjects include, but are not limited to, humans, domestic animals, farm animals, zoo animals, sport animals, pet animals such as dogs, cats, guinea pigs, rabbits, rats, mice, horses, cattle, cows; primates such as apes, monkeys, orangutans, and chimpanzees; canids such as dogs and wolves; felids such as cats, lions, and tigers; equids such as horses, donkeys, and zebras; bears, food animals such as cows, pigs, and sheep; ungulates such as deer and giraffes; rodents such as mice, rats, hamsters and guinea pigs; and so on. In certain embodiments, the mammal is a human subject. In other embodiments, a subject is a human patient. In a particular embodiment, a subject is a human patient in need of treatment.

Substantially: As used herein, the term "substantially" refers to the qualitative condition of exhibiting total or near-total extent or degree of a characteristic or property of interest. One of ordinary skill in the biological arts will understand that biological and chemical characteristics rarely, if ever, go to completion and/or proceed to completeness or achieve or avoid an absolute result. The term "substantially" is therefore used herein to capture the potential lack of completeness inherent in many biological and chemical characteristics.

Substantially equal: As used herein as it relates to time differences between doses, the term means plus/minus 2%.

Substantially simultaneous: As used herein and as it relates to plurality of doses, the term means within 2 seconds.

Suffering from: An individual who is "suffering from" a disease, disorder, and/or condition has been diagnosed with or displays one or more signs or symptoms of the disease, disorder, and/or condition.

Susceptible to: An individual who is "susceptible to" a disease, disorder, and/or condition has not been diagnosed with and/or can not exhibit signs or symptoms of the disease, disorder, and/or condition but harbors a propensity to develop a disease or its signs or symptoms. In some embodiments, an individual who is susceptible to a disease, disorder, and/or condition (for example, cancer) can be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or other molecules of the present invention can be chemical or enzymatic.

Targeted Cells: As used herein, "targeted cells" refers to any one or more cells of interest. The cells can be found in vitro, in vivo, in situ or in the tissue or organ of an organism. The organism can be an animal, for example a mammal, a human, a subject or a patient.

Target tissue: As used herein "target tissue" refers to any one or more tissue types of interest in which the delivery of a polynucleotide would result in a desired biological and/or pharmacological effect. Examples of target tissues of interest include specific tissues, organs, and systems or groups thereof. In particular applications, a target tissue can be a kidney, a lung, a spleen, vascular endothelium in vessels (e.g., intra-coronary or intra-femoral), or tumor tissue (e.g., via intratumoral injection). An "off-target tissue" refers to any one or more tissue types in which the expression of the encoded protein does not result in a desired biological and/or pharmacological effect. In particular applications, off-target tissues can include the liver and the spleen.

The presence of a therapeutic agent in an off-target issue can be the result of: (i) leakage of a polynucleotide from the administration site to peripheral tissue or distant off-target tissue (e.g., liver) via diffusion or through the bloodstream (e.g., a polynucleotide intended to express a polypeptide in a certain tissue would reach the liver and the polypeptide would be expressed in the liver); or (ii) leakage of an polypeptide after administration of a polynucleotide encoding such polypeptide to peripheral tissue or distant off-target tissue (e.g., liver) via diffusion or through the bloodstream (e.g., a polynucleotide would expressed a polypeptide in the target tissue, and the polypeptide would diffuse to peripheral tissue).

Targeting sequence: As used herein, the phrase "targeting sequence" refers to a sequence that can direct the transport or localization of a protein or polypeptide.

Terminus: As used herein the terms "termini" or "terminus," when referring to polypeptides, refers to an extremity of a peptide or polypeptide. Such extremity is not limited only to the first or final site of the peptide or polypeptide but can include additional amino acids in the terminal regions. The polypeptide based molecules of the invention can be characterized as having both an N-terminus (terminated by an amino acid with a free amino group ($NH_2$)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides can be modified such that they begin or end, as the case can be, with a non-polypeptide based moiety such as an organic conjugate.

Therapeutic Agent: The term "therapeutic agent" refers to an agent that, when administered to a subject, has a therapeutic, diagnostic, and/or prophylactic effect and/or elicits a desired biological and/or pharmacological effect. For example, in some embodiments, an mRNA encoding a relaxin polypeptide can be a therapeutic agent. In other embodiments, a therapeutic agent may be a therapeutic protein.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve signs or symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve signs or symptoms of, diagnose, prevent, and/or delay the onset of the infection, disease, disorder, and/or condition.

Total daily dose: As used herein, a "total daily dose" is an amount given or prescribed in 24 hr. period. The total daily dose can be administered as a single unit dose or a split dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors can regulate transcription of a target gene alone or in a complex with other molecules.

Transcription: As used herein, the term "transcription" refers to methods to produce mRNA (e.g., an mRNA sequence or template) from DNA (e.g., a DNA template or sequence).

Transfection: As used herein, "transfection" refers to the introduction of a polynucleotide into a cell wherein a polypeptide encoded by the polynucleotide is expressed (e.g., mRNA) or the polypeptide modulates a cellular function (e.g., siRNA, miRNA). As used herein, "expression" of a nucleic acid sequence refers to translation of a polynucleotide (e.g., an mRNA) into a polypeptide or protein and/or post-translational modification of a polypeptide or protein.

Treating, treatment, therapy: As used herein, the term "treating" or "treatment" or "therapy" refers to partially or completely alleviating, ameliorating, improving, relieving, delaying onset of, inhibiting progression of, reducing severity of, and/or reducing incidence of one or more signs or symptoms or features of a disease. For example, "treating" heart disease can refer to diminishing signs or symptoms associate with the disease, prolong the lifespan (increase the survival rate) of patients, reducing the severity of the disease, preventing or delaying the onset of the disease, etc. Treatment can be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in some way. Unmodified can, but does not always, refer to the wild type or native form of a biomolecule. Molecules can undergo a series of modifications whereby each modified molecule can serve as the "unmodified" starting molecule for a subsequent modification.

Uracil: Uracil is one of the four nucleobases in the nucleic acid of RNA, and it is represented by the letter U. Uracil can be attached to a ribose ring, or more specifically, a ribofuranose via a β-N1-glycosidic bond to yield the nucleoside uridine. The nucleoside uridine is also commonly abbreviated according to the one letter code of its nucleobase, i.e., U. Thus, in the context of the present disclosure, when a monomer in a polynucleotide sequence is U, such U is designated interchangeably as a "uracil" or a "uridine."

Uridine Content: The terms "uridine content" or "uracil content" are interchangeable and refer to the amount of uracil or uridine present in a certain nucleic acid sequence. Uridine content or uracil content can be expressed as an absolute value (total number of uridine or uracil in the sequence) or relative (uridine or uracil percentage respect to the total number of nucleobases in the nucleic acid sequence).

Uridine-Modified Sequence: The terms "uridine-modified sequence" refers to a sequence optimized nucleic acid (e.g., a synthetic mRNA sequence) with a different overall or local uridine content (higher or lower uridine content) or with different uridine patterns (e.g., gradient distribution or clustering) with respect to the uridine content and/or uridine patterns of a candidate nucleic acid sequence. In the content of the present disclosure, the terms "uridine-modified sequence" and "uracil-modified sequence" are considered equivalent and interchangeable.

A "high uridine codon" is defined as a codon comprising two or three uridines, a "low uridine codon" is defined as a codon comprising one uridine, and a "no uridine codon" is a codon without any uridines. In some embodiments, a uridine-modified sequence comprises substitutions of high uridine codons with low uridine codons, substitutions of high uridine codons with no uridine codons, substitutions of low uridine codons with high uridine codons, substitutions of low uridine codons with no uridine codons, substitution of no uridine codons with low uridine codons, substitutions of no uridine codons with high uridine codons, and combinations thereof. In some embodiments, a high uridine codon can be replaced with another high uridine codon. In some embodiments, a low uridine codon can be replaced with another low uridine codon. In some embodiments, a no uridine codon can be replaced with another no uridine codon. A uridine-modified sequence can be uridine enriched or uridine rarefied.

Uridine Enriched: As used herein, the terms "uridine enriched" and grammatical variants refer to the increase in uridine content (expressed in absolute value or as a percentage value) in a sequence optimized nucleic acid (e.g., a synthetic mRNA sequence) with respect to the uridine content of the corresponding candidate nucleic acid sequence. Uridine enrichment can be implemented by substituting codons in the candidate nucleic acid sequence with synonymous codons containing less uridine nucleobases. Uridine enrichment can be global (i.e., relative to the entire length of a candidate nucleic acid sequence) or local (i.e., relative to a subsequence or region of a candidate nucleic acid sequence).

Uridine Rarefied: As used herein, the terms "uridine rarefied" and grammatical variants refer to a decrease in uridine content (expressed in absolute value or as a percentage value) in an sequence optimized nucleic acid (e.g., a synthetic mRNA sequence) with respect to the uridine content of the corresponding candidate nucleic acid sequence. Uridine rarefication can be implemented by substituting codons in the candidate nucleic acid sequence with synonymous codons containing less uridine nucleobases. Uridine rarefication can be global (i.e., relative to the entire length of a candidate nucleic acid sequence) or local (i.e., relative to a subsequence or region of a candidate nucleic acid sequence).

Variant: The term variant as used in present disclosure refers to both natural variants (e.g, polymorphisms, isoforms, etc) and artificial variants in which at least one amino acid residue in a native or starting sequence (e.g., a wild type sequence) has been removed and a different amino acid inserted in its place at the same position. These variants can de described as "substitutional variants." The substitutions can be single, where only one amino acid in the molecule has been substituted, or they can be multiple, where two or more amino acids have been substituted in the same molecule. If amino acids are inserted or deleted, the resulting variant would be an "insertional variant" or a "deletional variant" respectively.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" can mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art can be explicitly excluded from any one or more of the claims. Since such embodiments are deemed to be known to one of ordinary skill in the art, they can be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1: Manufacture of Polynucleotides

According to the present disclosure, the manufacture of polynucleotides and or parts or regions thereof may be accomplished utilizing the methods taught in International Application WO2014/152027 entitled "Manufacturing Methods for Production of RNA Transcripts", the contents of which is incorporated herein by reference in its entirety.

Purification methods may include those taught in International Application WO2014/152030 and WO2014/152031, each of which is incorporated herein by reference in its entirety.

Detection and characterization methods of the polynucleotides may be performed as taught in WO2014/144039, which is incorporated herein by reference in its entirety.

Characterization of the polynucleotides of the disclosure may be accomplished using a procedure selected from the group consisting of polynucleotide mapping, reverse transcriptase sequencing, charge distribution analysis, and detection of RNA impurities, wherein characterizing comprises determining the RNA transcript sequence, determining the purity of the RNA transcript, or determining the charge heterogeneity of the RNA transcript. Such methods are taught in, for example, WO2014/144711 and WO2014/144767, the contents of each of which is incorporated herein by reference in its entirety.

Example 2: Chimeric Polynucleotide Synthesis

Introduction

According to the present disclosure, two regions or parts of a chimeric polynucleotide may be joined or ligated using triphosphate chemistry.

According to this method, a first region or part of 100 nucleotides or less is chemically synthesized with a 5' monophosphate and terminal 3'desOH or blocked OH. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 130 nucleotides may be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then it is preferable that such region or part comprise a phosphate-sugar backbone.

Ligation is then performed using any known click chemistry, orthoclick chemistry, solulink, or other bioconjugate chemistries known to those in the art.

Synthetic Route

The chimeric polynucleotide is made using a series of starting segments. Such segments include:

(a) Capped and protected 5' segment comprising a normal 3'OH (SEG. 1)

(b) 5' triphosphate segment which may include the coding region of a polypeptide and comprising a normal 3'OH (SEG. 2)

(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) is treated with cordycepin and then with pyrophosphatase to create the 5'monophosphate.

Segment 2 (SEG. 2) is then ligated to SEG. 3 using RNA ligase. The ligated polynucleotide is then purified and treated with pyrophosphatase to cleave the diphosphate. The treated SEG.2-SEG. 3 construct is then purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3: PCR for cDNA Production

PCR procedures for the preparation of cDNA are performed using 2×KAPA HIFI™ HotStart ReadyMix by Kapa Biosystems (Woburn, Mass.). This system includes 2×KAPA ReadyMix12.5 µl; Forward Primer (10 µM) 0.75 µl; Reverse Primer (10 µM) 0.75 µl; Template cDNA –100 ng; and dH$_2$0 diluted to 25.0 µl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reaction is cleaned up using Invitrogen's PURELINK™ PCR Micro Kit (Carlsbad, Calif.) per manufacturer's instructions (up to 5 µg). Larger reactions will require a cleanup using a product with a larger capacity. Following the cleanup, the cDNA is quantified using the NANODROP™ and analyzed by agarose gel electrophoresis to confirm the cDNA is the expected size. The cDNA is then submitted for sequencing analysis before proceeding to the in vitro transcription reaction.

Example 4: In Vitro Transcription (IVT)

The in vitro transcription reaction generates polynucleotides containing uniformly modified polynucleotides. Such uniformly modified polynucleotides may comprise a region or part of the polynucleotides of the disclosure. The input nucleotide triphosphate (NTP) mix is made in-house using natural and un-natural NTPs.

A typical in vitro transcription reaction includes the following:

| | | |
|---|---|---|
| 1 | Template cDNA | 1.0 µg |
| 2 | 10x transcription buffer (400 mM Tris-HCl pH 8.0, 190 mM MgCl$_2$, 50 mM DTT, 10 mM Spermidine) | 2.0 µl |
| 3 | Custom NTPs (25 mM each) | 7.2 µl |
| 4 | RNase Inhibitor | 20 U |
| 5 | T7 RNA polymerase | 3000 U |
| 6 | dH$_2$0 | Up to 20.0 µl. and |
| 7 | Incubation at 37° C. for 3 hr-5 hrs. | |

The crude IVT mix may be stored at 4° C. overnight for cleanup the next day. 1 U of RNase-free DNase is then used to digest the original template. After 15 minutes of incubation at 37° C., the mRNA is purified using Ambion's MEGACLEAR™ Kit (Austin, Tex.) following the manufacturer's instructions. This kit can purify up to 500 ag of RNA. Following the cleanup, the RNA is quantified using the NanoDrop and analyzed by agarose gel electrophoresis to confirm the RNA is the proper size and that no degradation of the RNA has occurred.

Example 5: Enzymatic Capping

Capping of a polynucleotide is performed as follows where the mixture includes: IVT RNA 60 µg-180 µg and dH$_2$0 up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 al); 20 mM GTP (5.0 al); 20 mM S-Adenosyl Methionine (2.5 al); RNase Inhibitor (100 U); 2'-O-Methyltransferase (400U); Vaccinia capping enzyme (Guanylyl transferase) (40 U); dH$_2$0 (Up to 28 al); and incubation at 37° C. for 30 minutes for 60 µg RNA or up to 2 hours for 180 µg of RNA.

The polynucleotide is then purified using Ambion's MEGACLEAR™ Kit (Austin, Tex.) following the manufacturer's instructions. Following the cleanup, the RNA is quantified using the NANODROP™ (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 6: PolyA Tailing Reaction

Without a poly-T in the cDNA, a poly-A tailing reaction must be performed before cleaning the final product. This is done by mixing Capped IVT RNA (100 al); RNase Inhibitor (20 U); 10× Tailing Buffer (0.5 M Tris-HCl (pH 8.0), 2.5 M NaCl, 100 mM MgCl$_2$)(12.0 al); 20 mM ATP (6.0 al); Poly-A Polymerase (20 U); dH$_2$0 up to 123.5 al and incubation at 37° C. for 30 min. If the poly-A tail is already in the transcript, then the tailing reaction may be skipped and proceed directly to cleanup with Ambion's MEGA-CLEAR™ kit (Austin, Tex.) (up to 500 ag). Poly-A Polymerase is preferably a recombinant enzyme expressed in yeast.

It should be understood that the processivity or integrity of the polyA tailing reaction may not always result in an exact size polyA tail. Hence polyA tails of approximately between 40-200 nucleotides, e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the invention.

Example 7: Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5')ppp(5')A; G(5')ppp(5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England Bio-Labs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-0 methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8: Capping Assays

A. Protein Expression Assay

Polynucleotides encoding a polypeptide, containing any of the caps taught herein can be transfected into cells at equal concentrations. 6, 12, 24 and 36 hours post-transfection the amount of protein secreted into the culture medium can be assayed by ELISA. Synthetic polynucleotides that secrete higher levels of protein into the medium would correspond to a synthetic polynucleotide with a higher translationally-competent Cap structure.

B. Purity Analysis Synthesis

Polynucleotides encoding a polypeptide, containing any of the caps taught herein can be compared for purity using denaturing Agarose-Urea gel electrophoresis or HPLC analysis. Polynucleotides with a single, consolidated band by electrophoresis correspond to the higher purity product compared to polynucleotides with multiple bands or streaking bands. Synthetic polynucleotides with a single HPLC peak would also correspond to a higher purity product. The capping reaction with a higher efficiency would provide a more pure polynucleotide population.

C. Cytokine Analysis

Polynucleotides encoding a polypeptide, containing any of the caps taught herein can be transfected into cells at multiple concentrations. 6, 12, 24 and 36 hours post-transfection the amount of pro-inflammatory cytokines such as TNF-alpha and IFN-beta secreted into the culture medium can be assayed by ELISA. Polynucleotides resulting in the secretion of higher levels of pro-inflammatory cytokines into the medium would correspond to a polynucleotides containing an immune-activating cap structure.

D. Capping Reaction Efficiency

Polynucleotides encoding a polypeptide, containing any of the caps taught herein can be analyzed for capping reaction efficiency by LC-MS after nuclease treatment. Nuclease treatment of capped polynucleotides would yield a mixture of free nucleotides and the capped 5'-5-triphosphate cap structure detectable by LC-MS. The amount of capped product on the LC-MS spectra can be expressed as a percent of total polynucleotide from the reaction and would correspond to capping reaction efficiency. The cap structure with higher capping reaction efficiency would have a higher amount of capped product by LC-MS.

Example 9: Agarose Gel Electrophoresis of Modified RNA or RT PCR Products

Individual polynucleotides (200-400 ng in a 20 µl volume) or reverse transcribed PCR products (200-400 ng) are loaded into a well on a non-denaturing 1.2% Agarose E-Gel (Invitrogen, Carlsbad, Calif.) and run for 12-15 minutes according to the manufacturer protocol.

Example 10: Nanodrop Modified RNA Quantification and UV Spectral Data

Modified polynucleotides in TE buffer (1 µl) are used for Nanodrop UV absorbance readings to quantitate the yield of each polynucleotide from an chemical synthesis or in vitro transcription reaction.

Example 11: Formulation of Modified mRNA Using Lipidoids

Polynucleotides are formulated for in vitro experiments by mixing the polynucleotides with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations may used as a starting point. After formation of the particle, polynucleotide is added and allowed to integrate with the complex. The encapsulation efficiency is determined using a standard dye exclusion assays.

Example 12: Relaxin mRNA Production of Functional Relaxin Protein

Relaxin mRNA variants were synthesized as described in Examples 1 to 11, with the goal of producing constructs that would have longer half-lives in blood. Wild-type relaxin consists of two peptides: A chain and B chain, and contains 53 amino acids. A variable light chain fraction (kappa) (VLk) of the human immunoglobulin IgG targeting human serum albumin, 108 amino acids, was synthesized and added to the A chain of wild type relaxin (FIG. 1).

Three independent transfection studies in EXP1293f cells and cAMP assays in RXFP1-expressing CHO-K1 cells were performed (FIG. 2). The in vitro proof-of-activity assays demonstrated that the VLk-hRLN2 mRNA produces a functional relaxin protein. Interestingly, the VLk fusion protein was found to be less active (approximately 50%) in vitro compared to wild type relaxin. All mRNAs tested gave rise to VLk-hRLN2 proteins with similarly specific activity.

Figure 6:
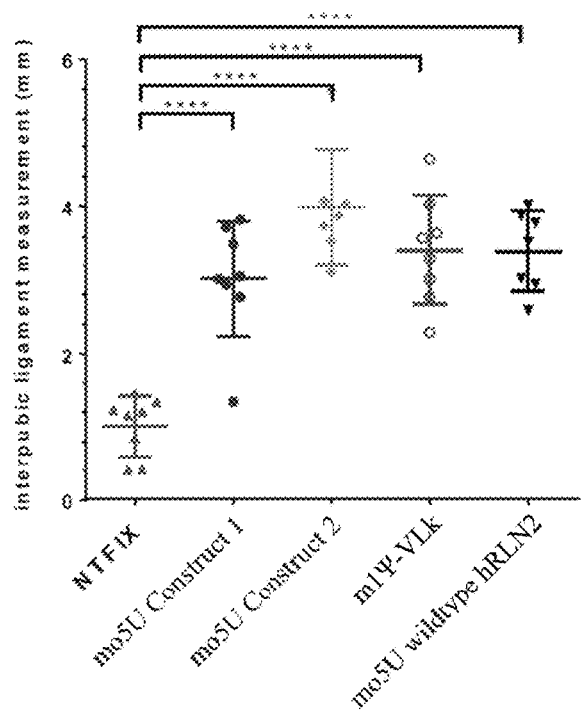

The VLk-hRLN2 fusion protein was also shown to produce a functional protein in the in vivo interpubic ligament elongation (ILE) assay in mice. Estradiol-primed CD1 female mice were administered a single IV bolus (0.5 mg/kg) of the VLk-hRLN2 fusion protein. Twenty-four hours later, the mice were dissected, and interpubic ligaments were measured. As shown in FIG. 6, the interpubic ligament measurement was significantly higher in all of the tested variants compared to the negative control group.

Example 13: Relaxin mRNA In Vivo Studies: Spontaneously Hypertensive Rats

Spontaneously hypertensive rats were used to study the effects of the VLk-hRLN2 construct in vivo. Rats were first implanted with telemetric devices. Blood was collected to determine the baseline circulating Relaxin levels. Throughout the study, heart rate and blood pressure were continuously monitored (systolic and diastolic arterial blood pressure were measured for 10 seconds every 10 minutes). Rats were separated into four groups (N=8 rats per group): mo5U-construct 1, mo5U-wild-type, m1ΨLuc, and rhRLN2. The first three groups were subjected to three IV-infusions, seven days apart. The fourth group, rhRLN2, had subcutaneous pumps implanted and were administered rhRLN2 over a 14-day infusion period at a constant rate. Blood was collected from all rats before the infusion, and then 6 hours, 12 hours, one day, two days, four days, and six days after the infusion (in the case of the IV groups, the next "pre" dose measurement was on the seventh day, before the IV dose was administered).

The VLk-hRLN2 mRNA was shown to produce a functional protein with sustained activity in IV-injected spontaneously hypertensive rats. Heart rate data, shown in FIG. 3A, demonstrates that the relaxin VLk fusion protein was less potent compared to wild type relaxin in vivo. The data shown are averaged per daytime and nighttime periods (means+/−SD) with periods of manipulation of the animals removed (N=8 rats per group). Heart rate data oscillates between troughs (day time) and peaks (night time) in rats. The diastolic arterial pressure data (FIG. 3B) also demonstrated that the VLk fusion protein had sustained activity in vivo. Although less potent, the longer half life can provide therapeutic benefit to the active compound.

Figure 7:
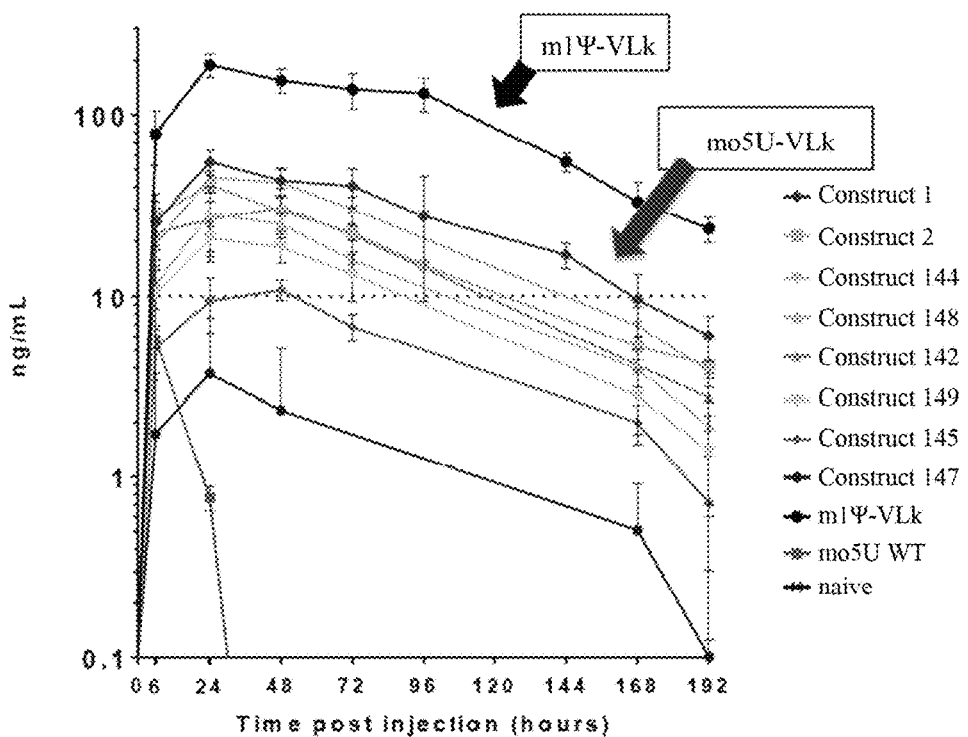

Circulating relaxin protein levels in spontaneously hypertensive rats were also measured (FIG. 4). The WKY rats were give a single-bolus, 0.5 mg/kg injection of the RNA encoding VLk fusion protein, construct 1 (SEQ ID NO. 5), in compound 18-containing nanoparticles. Human RLN2 protein ELISA was performed on the plasma samples; the VLk fusion protein blood levels were found to be higher than wild type relaxin in the rat model (FIG. 7).

Example 14: Relaxin mRNA In Vivo Studies: Cynomolgus Monkeys

The circulating protein levels of relaxin in cynomolgus monkeys were also investigated. Two groups of cynomolgus monkeys (N=5 naïve male monkeys per group) were tested using IV infusions or subcutaneous injections. The IV group was given 0.5 mg/kg of relaxin-2 mRNA (the VLk fusion protein, construct 1, RNA of SEQ ID NO. 1) in compound 18-containing lipid nanoparticles in a one hour infusion every other week for four weeks. The dose concentration of 0.1 mg/mL, to a volume of 5 mL/kg. The subcutaneous group received relaxin 2 mRNA (the VLk fusion protein, RNA of SEQ ID NO. 1) in compound 18-containing lipid nanoparticles co-formulated with a corticosteroid. The dose volume was 0.5 mL/kg and the dose concentration was 1.0 mg/mL.

Figure 9:
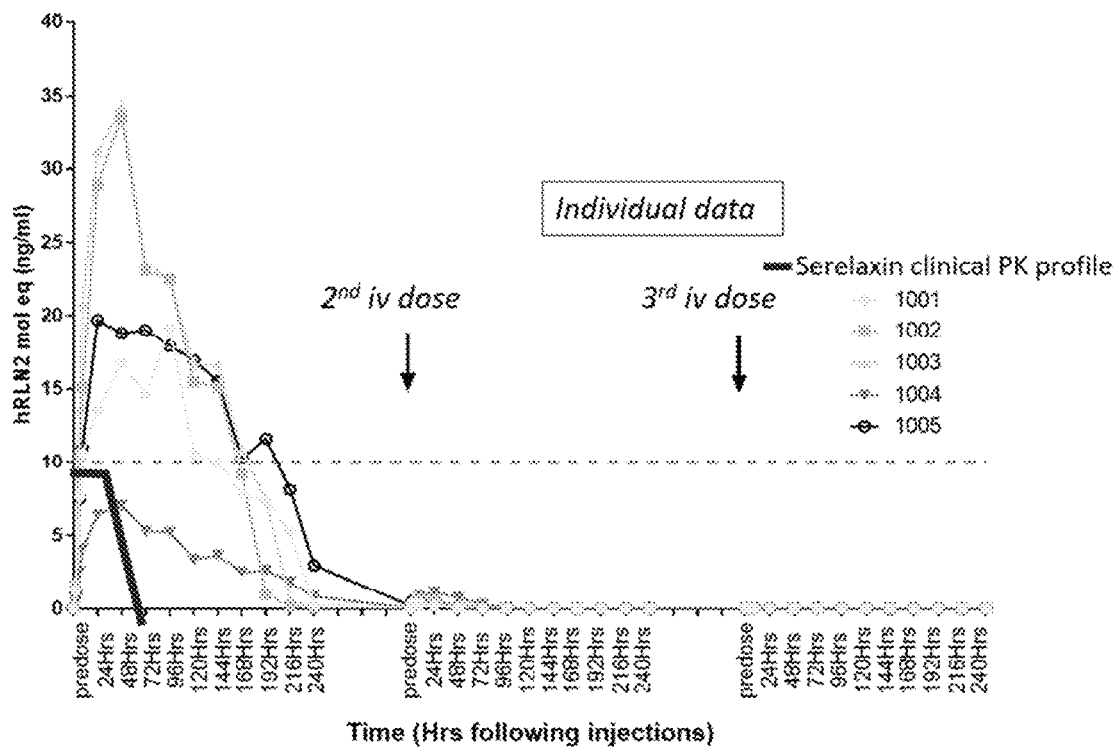

Circulating levels of relaxin were found to be above the target concentrations in IV-injected cynomolgus monkeys for up to six days after the infusion (FIG. 5). Note that, at 14 days, all subjects had returned to baseline. However, redosing was shown to yield low protein pharmacokinetics (FIG. 9).

Figure 10:
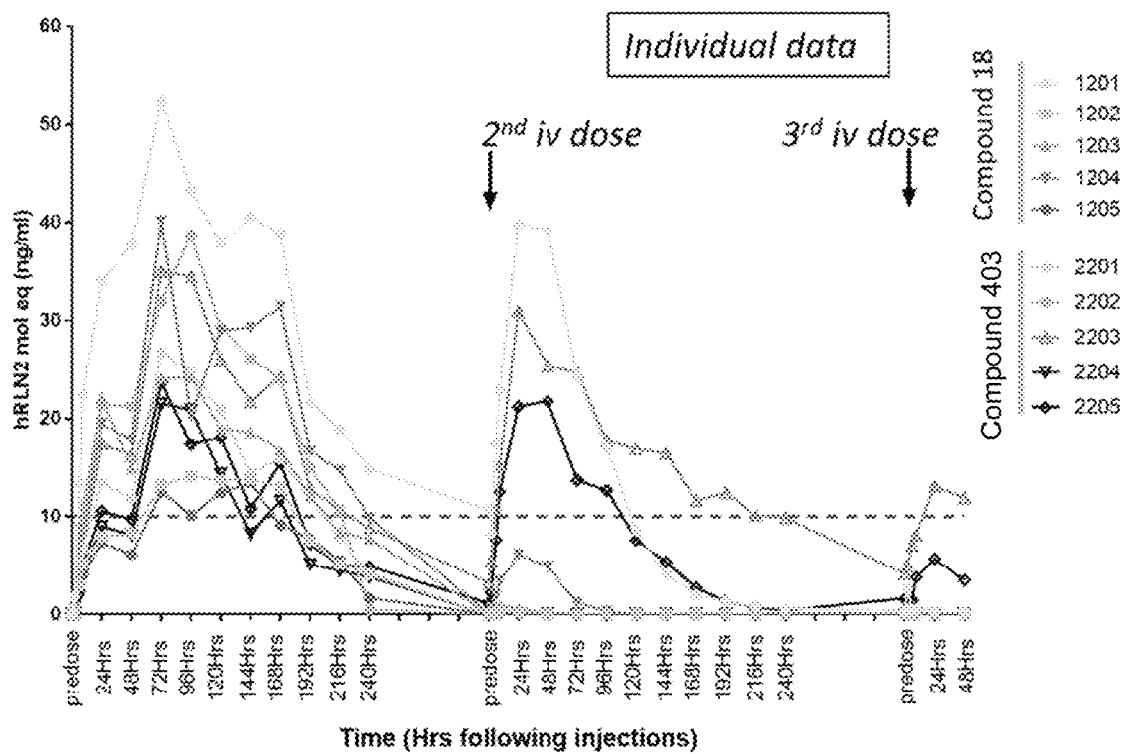
Figure 11:
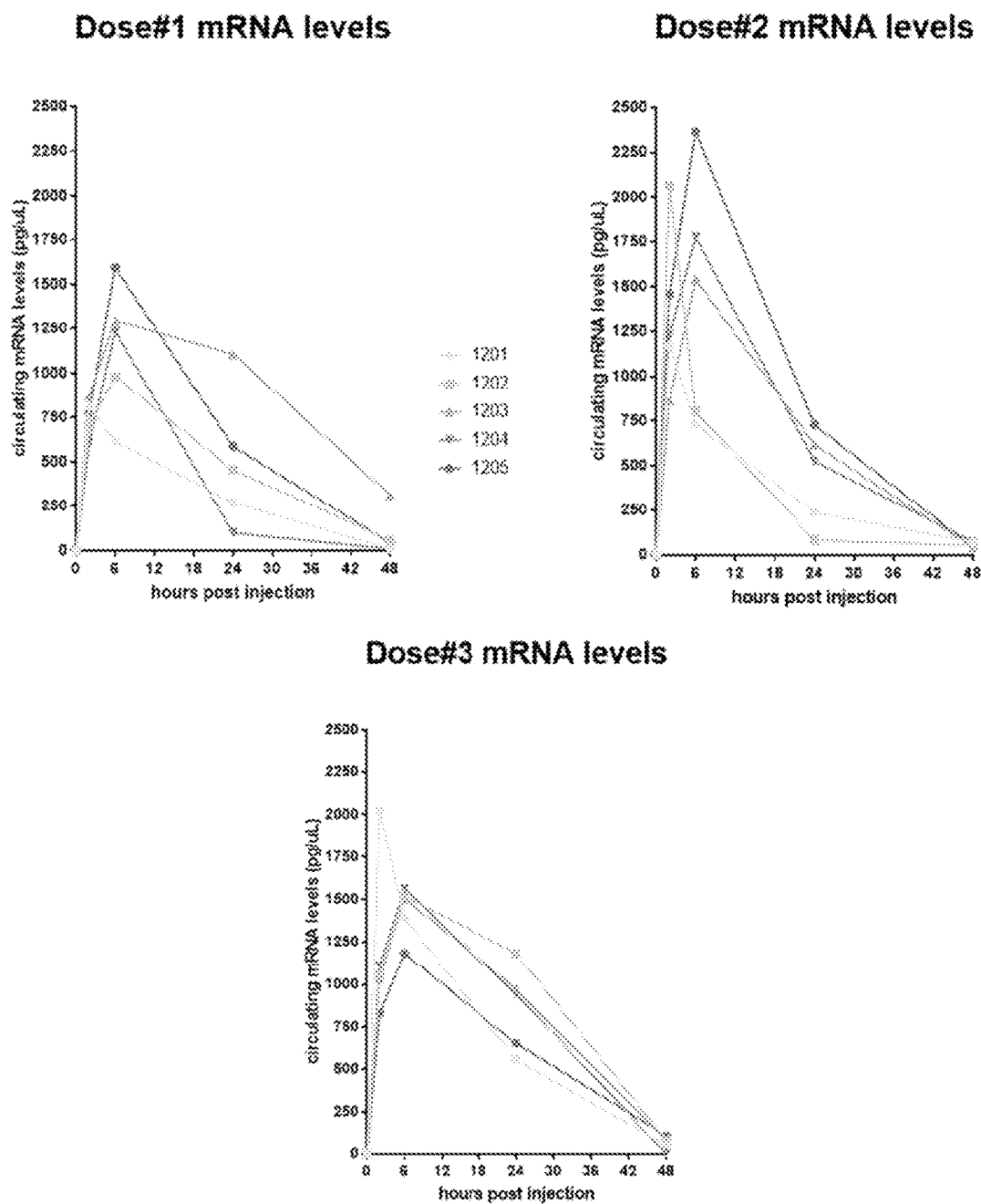
Figure 12:
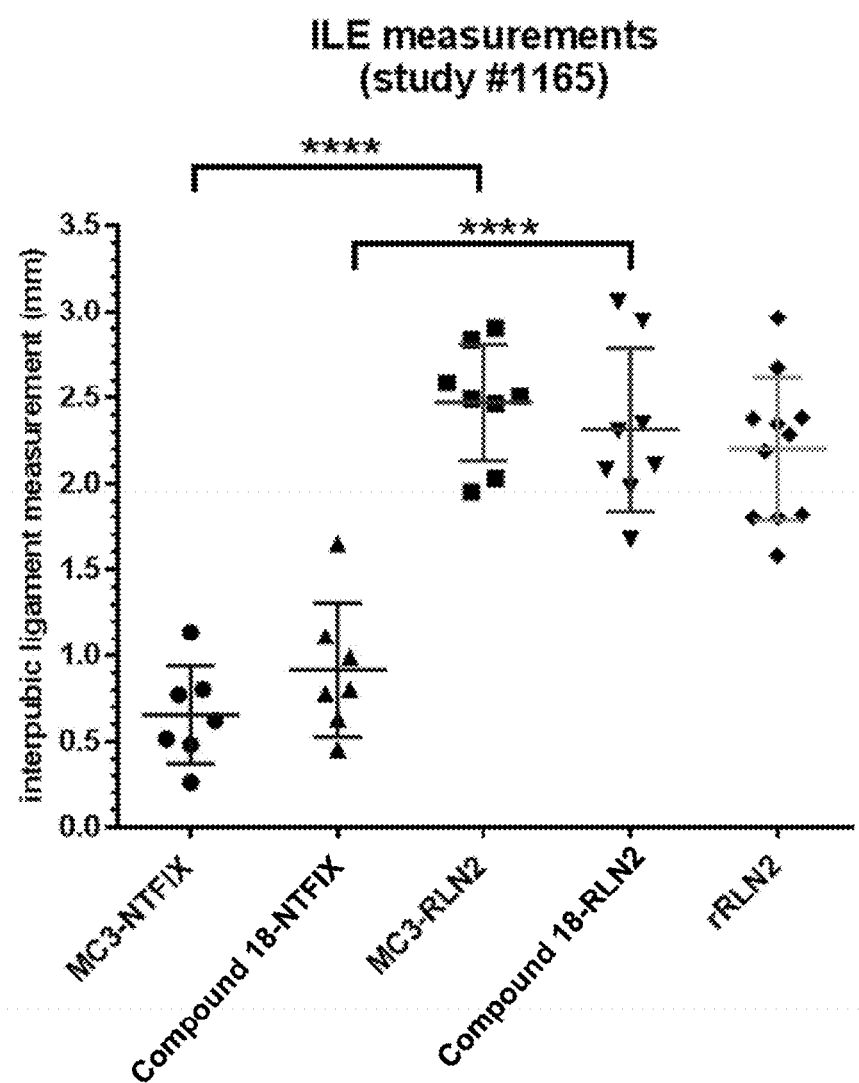

An additional study also investigated the effects of repeat IV dosing using two different lipid nanoparticle formulations in cynomolgus monkeys. In this study, an RNA of SEQ ID NO. 1 was formulated in two different lipid nanoparticles: one containing compound 18 and another containing compound 403. Subjects were given 0.5 mg/kg of the either formulation every other week for four weeks. Plasma samples were then assayed using a human relaxin-2 ELISA, and the results are shown in FIG. 10. In addition, circulating mRNA levels of the RNA of SEQ ID NO. 5 were found to be similar after the first, second, and third doses, as demonstrated by a bDNA assay using plasma from the study described above (FIG. 11).

Example 15: Relaxin mRNA In Vivo Studies: Mice

Figure 8:
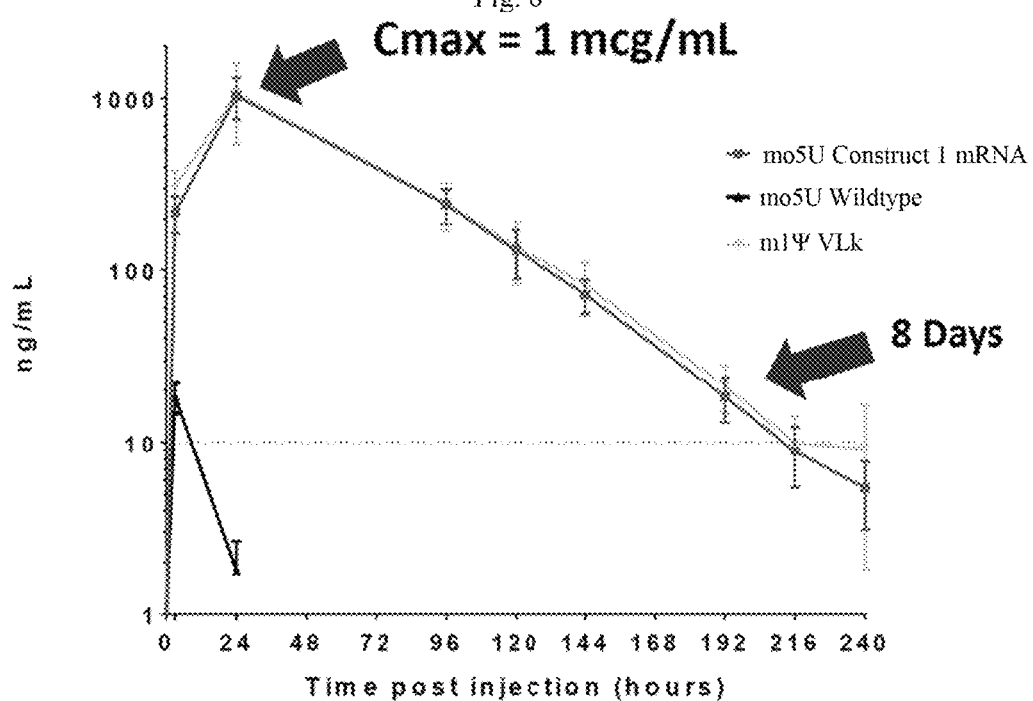

Mice were IV-injected with relaxin-2 mRNA (encoding the VLk fusion protein of SEQ ID NO. 2) and the concentration of circulating relaxin was measured at different time points post-infusion. It was found that the relaxin-2 mRNA (the VLk fusion protein, construct 1) expresses concentrations of relaxin above those of the target concentration for up to eight days (FIG. 8).

Sequences

TABLE 5

Amino Acid Sequences

| | Sequence | SEQ ID NO: |
|---|---|---|
| Construct 1 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 6 |
| Construct 2 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 7 |
| Construct 3 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 8 |
| Construct 4 | MPRLFFFHLLGVCLLLNQFSRAVADSWMEEVIKLCGRELVRAQI AICGMGGGGSGGGGSGGGGSGGGGSGGGGSGGGGSGGGGSGG GGSGGGGSGGGGSGGGGSGGGGSGGGGSGGGGSGGGGSGGGG SGGGGSGGGGSGGGGSGGGGSQLYSALANKCCHVGCTKRSLAR FC | 9 |
| Construct 5 | MPRLFFFHLLGVCLLLNQFSRAVADSWMEEVIKLCGRELVRAQI AICGMGGGGSGGGGSGGGGSGGGGSGGGGSGGGGSGGGGSFQS SSSKAPPPSLPSPSRLPGPSDTPILPQGGGGSGGGGSGGGGSGGGG SGGGGSGGGGSGGGGSQLYSALANKCCHVGCTKRSLARFC | 10 |
| Construct 6 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 11 |
| Construct 7 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 12 |
| Construct 8 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 13 |

TABLE 5-continued

Amino Acid Sequences

| Sequence | | SEQ ID NO: |
|---|---|---|
| Construct 9 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 14 |
| Construct 10 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 15 |
| Construct 11 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 16 |
| Construct 12 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 17 |
| Construct 13 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 18 |
| Construct 14 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 19 |
| Construct 15 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 20 |
| Construct 16 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 21 |
| Construct 17 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 22 |
| Construct 18 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 23 |
| Construct 19 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 24 |
| Construct 20 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 25 |
| Construct 21 | MPRLFFFHLLGVCLLLNQFSRAVADSWMEEVIKLCGRELVRAQI AICGMSTWSKRSLSQEDAPQTPRPVAEIVPSF | 26 |

TABLE 5-continued

Amino Acid Sequences

| | Sequence | SEQ ID NO: |
|---|---|---|
| | VANLPQELKLTLSEMQPALPQLQQHVPVLKDSSLLFEEFKKLIRN RQSEAADSSPSELKYLGLDTHSRKKRQLYSALANKCCHVGCTKR SLARFC | |
| Construct 22 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 27 |
| Construct 23 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 28 |
| Construct 24 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 29 |
| Construct 25 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 30 |
| Construct 26 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 31 |
| Construct 27 | MPRLFFFHLLGVCLLLNQFSRAVADSWMEEVIKLCGRELVRAQI AICGMSTWSGSNGSTNDSNGSTGSQLYSALANKCCHVGCTKRSL ARFC | 32 |
| Construct 28 | MPRLFFFHLLGVCLLLNQFSRAVADSWMEEVIKLCGRELVRAQI AICGMSTWSGSNGSTNTSNGDTGSQLYSALANKCCHVGCTKRSL ARFC | 33 |
| Construct 29 | MPRLFFFHLLGVCLLLNQFSRAVADSWMEEVIKLCGRELVRAQI AICGMSTWSGSNGKTNTSNGDTGSQLYSALANKCCHVGCTKRSL ARFC | 34 |
| Construct 30 | MPRLFFFHLLGVCLLLNQFSRAVADSWMEEVIKLCGRELVRAQI AICGMSTWSGSTNSGSTSSGNSGSGNSGSQLYSALANKCCHVGC TKRSLARFC | 35 |
| Construct 31 | MPRLFFFHLLGVCLLLNQFSRAVADSWMEEVIKLCGRELVRAQI AICGMSTWSGSTNSGSDTSSGNSGSGNSGQLYSALANKCCHVGC TKRSLARFC | 36 |
| Construct 32 | MPRLFFFHLLGVCLLLNQFSRAVADSWMEEVIKLCGRELVRAQI AICGMSTWSGSTNSGSDTGSGNSKSGNSGQLYSALANKCCHVGC TKRSLARFC | 37 |
| Construct 33 | MPRLFFFHLLGVCLLLNQFSRAVADSWMEEVIKLCGRELVRAQI AICGMSTWSGSTNSGSDTSGKNSGDGNSGQLYSALANKCCHVG CTKRSLARFC | 38 |
| Construct 34 | MPRLFFFHLLGVCLLLNQFSRAVADSWMEEVIKLCGRELVRAQI AICGMSTWSGSTDSGSDTSSGNSGDGNSGQLYSALANKCCHVGC TKRSLARFC | 39 |
| Construct 35 | MPRLFFFHLLGVCLLLNQFSRAVADSWMEEVIKLCGRELVRAQI AICGMSTWSGSSGSTNDSNGSTGTGSDGSTNGSDGSTGGQLYSA LANKCCHVGCTKRSLARFC | 40 |
| Construct 36 | MPRLFFFHLLGVCLLLNQFSRAVADSWMEEVIKLCGRELVRAQI AICGMSTWSGSTNSGSDTSSGSTNSGSDTSSGNSGSGNSGSKGTG SDGSTNGSNGSTGGQLYSALANKCCHVGCTKRSLARFC | 41 |

TABLE 5-continued

Amino Acid Sequences

| | Sequence | SEQ ID NO: |
|---|---|---|
| Construct 37 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSMVRSVECPPCPAPPVAGPSVFLFP PKPKDTLMISRTPEVTCVVVDVSHEDPEVQFNWYVDGMEVHNA KTKPREEQFNSTFRVVSVLTVVHQDWLNGKEYKCAVSNKGLPA PIEKTISKTKGQPREPQVYTLPPSREEMTKNQVSLTCLVKGFYPSD IAVEWESNGQPENNYKTTPPMLDSDGSFFLYSKLTVDKSRWQQG NVFSCSVMHEALHNHYTQKSLSLSPGKGKPIPNPLLGLDSTHHHH HH | 42 |
| Construct 38 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKRGKPIPNP LLGLDSTHHHHHH | 43 |
| Construct 39 | MPRLFFFHLLGVCLLLNQFSRAVADSWMEEVIKLCGRELVRAQI AICGMSTWSGSSGGGSGSSSGSSGSGGSGQLYSALANKCCHVGC TKRSLARFC | 44 |
| Construct 40 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 45 |
| Construct 41 | MGVKVLFALICIAVAEADSWMEEVIKLCGRELVRAQIAICGMST WSKRSLSQEDAPQTPRPVAEIVPSFINKDTETINMMSEFVANLPQE LKLTLSEMQPALPQLQQHVPVLKDSSLLFEEFKKLIRNRQSEAAD SSPSELKYLGLDTHSRKKRQLYSALANKCCHVGCTKRSLARFC | 46 |
| Construct 42 | MGVKVLFALICIAVAEADSWMEEVIKLCGRELVRAQIAICGMEP KSSDKTHTSPPSPAPELLGGSSVFLFPPKPKDTLYITREPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTL PPSRDELTKNQVSLTCLVKGFYPSDIAVEWESNGQPENNYKTTPP VLDSDGSFFLYSKLTVDKSRWQQGNVFSCSVMHEALHNHYTQK SLSLSPGKRKSTWSKRSLSQEDAPQTPRPVAEIVPSFINKDTETIN MMSEFVANLPQELKLTLSEMQPALPQLQQHVPVLKDSSLLFEEF KKLIRNRQSEAADSSPSELKYLGLDTHSRKKRQLYSALANKCCH VGCTKRSLARFC | 47 |
| Construct 43 | MGVKVLFALICIAVAEADSWMEEVIKLCGRELVRAQIAICGMGG GGSGGGGSGGGGSGGGGSGGGGSGGGGSGGGGSFQSSSSKAPPP SLPSPSRLPGPSDTPILPQGGGGSGGGGSGGGGSGGGGSGGGGSG GGGSGGGGSQLYSALANKCCHVGCTKRSLARFC | 48 |
| Construct 44 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 49 |
| Construct 45 | MGVKVLFALICIAVAEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 50 |
| Construct 46 | MGVKVLFALICIAVAEADSWMEEVIKLCGRELVRAQIAICGMST WSKRSLSQEDAPQTPRPVAEIVPSFINKDTETINMMSEFVANLPQE LKLTLSEMQPALPQLQQHVPVLKDSSLLFEEFKKLIRNRQSEAAD SSPSELKYLGLDTHSRKKRQLYSALANKCCHVGCTKRSLARFC | 51 |

TABLE 5-continued

Amino Acid Sequences

| | Sequence | SEQ ID NO: |
|---|---|---|
| Construct 47 | MSSRLLLQLLGFWLFLSQPCRARVSEEWMDQVIQVCGRGYARA WIEVCGPSVGRLALSQEEPAPLARQATAEVVPSFINKDAEPFDMT LKCLPNLSEERKAALSEGRAPFPELQQHAPALSDSVVRLEGFKKT FHNQLGEAEDGGPPELKYLGSDAQSRKKRQSGALLSEQCCHIGC TRRSIAKLC | 52 |
| Construct 48 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPREP YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 53 |
| Construct 49 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 54 |
| Construct 50 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 55 |
| Construct 51 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPREP YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 56 |
| Construct 52 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 57 |
| Construct 53 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 58 |
| Construct 54 | MGVKVLFALICIAVAEADSWMEEVIKLCGRELVRAQIAICGMST WSEPKSSDKTHTSPPSPAPELLGGSSVFLFPPKPKDTLYITREPEVT | 59 |

TABLE 5-continued

Amino Acid Sequences

| | Sequence | SEQ ID NO: |
|---|---|---|
| | CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | |
| Construct 55 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 60 |
| Construct 56 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 61 |
| Construct 57 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 62 |
| Construct 58 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 63 |
| Construct 59 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 64 |
| Construct 60 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE | 65 |

TABLE 5-continued

Amino Acid Sequences

| | Sequence | SEQ ID NO: |
|---|---|---|
| | FKKLIRNRQSEAADSSPSELKYLGLDTHSRKKRQLYSALANKCCH VGCTKRSLARFC | |
| Construct 61 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 66 |
| Construct 62 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 67 |
| Construct 63 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 68 |
| Construct 64 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 69 |
| Construct 65 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 70 |
| Construct 66 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | 71 |
| Construct 67 | MGVKVLFALICIAVAEADSWMEEVIKLCGRELVRAQIAICGMST WSEPKSSDKTHTSPPSPAPELLGGSSVFLFPPKPKDTLYITREPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSRDELTKNQVSLTCLVKGFYPSDIAVEWESNGQPENN | 72 |

TABLE 5-continued

Amino Acid Sequences

| | Sequence | SEQ ID NO: |
|---|---|---|
| | YKTTPPVLDSDGSFFLYSKLTVDKSRWQQGNVFSCSVMHEALHN HYTQKSLSLSPGKRKKRSLSQEDAPQTPRPVAEIVPSFINKDTETI NMMSEFVANLPQELKLTLSEMQPALPQLQQHVPVLKDSSLLFEE FKKLIRNRQSEAADSSPSELKYLGLDTHSRKKRQLYSALANKCCH VGCTKRSLARFC | |
| Construct 68 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 73 |
| Construct 69 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 74 |
| Construct 70 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 75 |
| Construct 71 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 76 |
| Construct 72 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 77 |
| Construct 73 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 78 |
| Construct 74 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 79 |
| Construct 75 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 80 |
| Construct 76 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 81 |
| Construct 77 | MGVKVLFALICIAVAEEADSWMEEVIKLCGRELVRAQIAICGMST WSGGGGSGGGGSGGGGSGGGGSGGGGSGGGGSGGGGSFQSSSS KAPPPSLPSPSRLPGPSDTPILPQGGGGSGGGGSGGGGSGGGGSG GGGSGGGGSGGGGSQLYSALANKCCHVGCTKRSLARFC | 82 |
| Construct 78 | MGVKVLFALICIAVAEEADSWMEEVIKLCGRELVRAQIAICGMEP KSSDKTHTSPPSPAPELLGGSSVFLFPPKPKDTLYITREPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTL PPSRDELTKNQVSLTCLVKGFYPSDIAVEWESNGQPENNYKTTPP VLDSDGSFFLYSKLTVDKSRWQQGNVFSCSVMHEALHNYTQK SLSLSPGKRKSTWSKRSLSQEDAPQTPRPVAEIVPSFINKDTETIN MMSEFVANLPQELKLTLSEMQPALPQLQQHVPVLKDSSLLFEEF KKLIRNRQSEAADSSPSELKYLGLDTHSRKKRQLYSALANKCCH VGCTKRSLARFC | 83 |
| Construct 79 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNYTQKSLSLSPGKRKKRSLSQEDAPQTPRPVAEIVPSFINK | 84 |

TABLE 5-continued

Amino Acid Sequences

| | Sequence | SEQ ID NO: |
|---|---|---|
| | DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | |
| Construct 80 | MPRLFFFHLLGVCLLLNQFSRAVADSWMEEVIKLCGRELVRAQI<br>AICGMSTWSGGGGSGGGGSGGGGSGGGGSGGGGSGGGGSGGG<br>GSFQSSSSKAPPPSLPSPSRLPGPSDTPILPQGGGGSGGGGSGGGGS<br>GGGGSGGGGSGGGGSGGGGSQLYSALANKCCHVGCTKRSLARF<br>C | 85 |
| Construct 81 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 86 |
| Construct 82 | MGVKVLFALICIAVAEADSWMEEVIKLCGRELVRAQIAICGMST<br>WSEPKSSDKTHTSPPSPAPELLGGSSVFLFPPKPKDTLYITREPEVT<br>CVVVDVSHEDPEVKFNWYVDGVEVHNAKTKPREEQYNSTYRV<br>VSVLTVLHQDWLNGKEYKCKVSNKALPAPIEKTISKAKGQPREP<br>QVYTLPPSRDELTKNQVSLTCLVKGFYPSDIAVEWESNGQPENN<br>YKTTPPVLDSDGSFFLYSKLTVDKSRWQQGNVFSCSVMHEALHN<br>HYTQKSLSLSPGKRKKRSLSQEDAPQTPRPVAEIVPSFINKDTETI<br>NMMSEFVANLPQELKLTLSEMQPALPQLQQHVPVLKDSSLLFEE<br>FKKLIRNRQSEAADSSPSELKYLGLDTHSRKKRQLYSALANKCCH<br>VGCTKRSLARFC | 87 |
| Construct 83 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 88 |
| Construct 84 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 89 |
| Construct 85 | MPRLFFFHLLGVCLLLNQFSRAVADSWMEEVIKLCGRELVRAQI<br>AICGMSTWSEVQLLESGGGLVQPGGSLRLSCVASGFTFNSSAMS<br>WVRQAPGKGLEWVSAISGSGDRTYYADSVKGRFTISRDNSKNTL<br>YLQMNSLRAEDTAVYYCTTDPPRYHYNGLAVRGQGTTVTVSSK<br>RSLSQEDAPQTPRPVAEIVPSFINKDTETINMMSEFVANLPQELKL<br>TLSEMQPALPQLQQHVPVLKDSSLLFEEFKKLIRNRQSEAADSSPS<br>ELKYLGLDTHSRKKRQLYSALANKCCHVGCTKRSLARFC | 90 |
| Construct 86 | MPRLFFFHLLGVCLLLNQFSRAVADSWMEEVIKLCGRELVRAQI<br>AICGMSTWSEVQLLESGGGLVQPGGSLRLSCAASGFTFSSYAMS<br>WVRQAPGKGLEWVSAISGSGGSTYYADSVKGRFTISRDNSKNTL<br>YLQMNSLRAEDTAVYYCTKDPPRYHYTGLAVRGQGTTVTVSSK<br>RSLSQEDAPQTPRPVAEIVPSFINKDTETINMMSEFVANLPQELKL<br>TLSEMQPALPQLQQHVPVLKDSSLLFEEFKKLIRNRQSEAADSSPS<br>ELKYLGLDTHSRKKRQLYSALANKCCHVGCTKRSLARFC | 91 |
| Construct 87 | MPRLFFFHLLGVCLLLNQFSRAVADSWMEEVIKLCGRELVRAQI<br>AICGMSTWSGSTDSGSDTSSGNSGDGNSGFQSSSSKAPPPSLPSPS<br>RLPGPSDTPILPQFQSSSSKAPPPSLPSPSRLPGPSDTPILPQGSTDSG<br>SDTSSGNSGDGNSGQLYSALANKCCHVGCTKRSLARFC | 92 |

TABLE 5-continued

Amino Acid Sequences

| | Sequence | SEQ ID NO: |
|---|---|---|
| Construct 88 | MPRLFFFHLLGVCLLLNQFSRAVADSWMEEVIKLCGRELVRAQI<br>AICGMSTWSGGGGSFQSSSSKAPPPSLPSPSRLPGPSDTPILPQFQS<br>SSSKAPPPSLPSPSRLPGPSDTPILPQGGGGSQLYSALANKCCHVG<br>CTKRSLARFC | 93 |
| Construct 89 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 94 |
| Construct 90 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 95 |
| Construct 91 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 96 |
| Construct 92 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 97 |
| Construct 93 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 98 |
| Construct 94 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 99 |
| Construct 95 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI | 100 |

TABLE 5-continued

Amino Acid Sequences

| | Sequence | SEQ ID NO: |
|---|---|---|
| | TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | |
| Construct 96 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 101 |
| Construct 97 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 102 |
| Construct 98 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 103 |
| Construct 99 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 104 |
| Construct 100 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 105 |
| Construct 101 | MPRLFFFHLLGVCLLLNQFSRAVADSWMEEVIKLCGRELVRAQI<br>AICGMSTWSEPKSSDKTHTSPPSPAPELLGGSSVFLFPPKPKDTLYI<br>TREPEVTCVVVDVSHEDPEVKFNWYVDGVEVHNAKTKPREEQY<br>NSTYRVVSVLTVLHQDWLNGKEYKCKVSNKALPAPIEKTISKAK<br>GQPREPQVYTLPPSRDELTKNQVSLTCLVKGFYPSDIAVEWESNG<br>QPENNYKTTPPVLDSDGSFFLYSKLTVDKSRWQQGNVFSCSVMH<br>EALHNHYTQKSLSLSPGKRKKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 106 |

TABLE 5-continued

Amino Acid Sequences

| | Sequence | SEQ ID NO: |
|---|---|---|
| Construct 102 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 107 |
| Construct 103 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 108 |
| Construct 104 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 109 |
| Construct 105 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 110 |
| Construct 106 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 111 |
| Construct 107 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 112 |
| Construct 108 | MPRLFFFHLLGVCLLLNQFSRAVADSWMEEVIKLCGRELVRAQI AICGMSTWSEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRKKRSLSQEDAPQTPRPVAEIVPSFINK | 113 |

TABLE 5-continued

Amino Acid Sequences

| | Sequence | SEQ ID NO: |
|---|---|---|
| | DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | |
| Construct 109 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 114 |
| Construct 110 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 115 |
| Construct 111 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 116 |
| Construct 112 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 117 |
| Construct 113 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 118 |
| Construct 114 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 119 |
| Construct 115 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR | 120 |

TABLE 5-continued

Amino Acid Sequences

| | Sequence | SEQ ID NO: |
|---|---|---|
| | EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | |
| Construct 116 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 121 |
| Construct 117 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 122 |
| Construct 118 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 123 |
| Construct 119 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 124 |
| Construct 120 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 125 |
| Construct 121 | MPRLFFFHLLGVCLLLNQFSRAVADSWMEEVIKLCGRELVRAQI<br>AICGMEPKSSDKTHTSPPSPAPELLGGSSVFLFPPKPKDTLYITREP<br>EVTCVVVDVSHEDPEVKFNWYVDGVEVHNAKTKPREEQYNSTY<br>RVVSVLTVLHQDWLNGKEYKCKVSNKALPAPIEKTISKAKGQPR<br>EPQVYTLPPSRDELTKNQVSLTCLVKGFYPSDIAVEWESNGQPEN<br>NYKTTPPVLDSDGSFFLYSKLTVDKSRWQQGNVFSCSVMHEALH<br>NHYTQKSLSLSPGKRKSTWSKRSLSQEDAPQTPRPVAEIVPSFINK<br>DTETINMMSEFVANLPQELKLTLSEMQPALPQLQQHVPVLKDSSL<br>LFEEFKKLIRNRQSEAADSSPSELKYLGLDTHSRKKRQLYSALAN<br>KCCHVGCTKRSLARFC | 126 |

TABLE 5-continued

Amino Acid Sequences

| | Sequence | SEQ ID NO: |
|---|---|---|
| Construct 122 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 127 |
| Construct 123 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 128 |
| Construct 124 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 129 |
| Construct 125 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 130 |
| Construct 126 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 131 |
| Construct 127 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL LFEEFKKLIRNRQSEAADSSPSELKYLGLDTHSRKKRQLYSALAN KCCHVGCTKRSLARFC | 132 |
| Construct 128 | MPRLFFFHLLGVCLLLNQFSRAVADSWMEEVIKLCGRELVRAQI AICGMEPKSSDKTHTSPPSPAPELLGGSSVFLFPPKPKDTLYITREP EVTCVVVDVSHEDPEVKFNWYVDGVEVHNAKTKPREEQYNSTY RVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGKRKSTWSKRSLSQEDAPQTPRPVAEIVPSFINK DTETINMMSEFVANLPQELKLTLSEMQPALPQLQQHVPVLKDSSL | 133 |

TABLE 5-continued

Amino Acid Sequences

| | Sequence | SEQ ID NO: |
|---|---|---|
| | LFEEFKKLIRNRQSEAADSSPSELKYLGLDTHSRKKRQLYSALAN KCCHVGCTKRSLARFC | |
| Construct 129 | MPRLFFFHLLGVCLLLNQFSRAVADSWMEEVIKLCGRELVRAQI AICGMSTWSGSTDSGSDTSSGNSGDGNSGQLYSALANKCCHVGC TKRSLARFCGSTDSGSDTSSGNSGDGNSGGSSGGGSGSSSGSSGS GGSGGSTDSGSDTSSGNSGDGNSGGSSGGGSGSSSGSSGSGGSGE PKSSDKTHTSPPSPAPELLGGSSVFLFPPKPKDTLYITREPEVTCVV VDVSHEDPEVKFNWYVDGVEVHNAKTKPREEQYNSTYRVVSVL TVLHQDWLNGKEYKCKVSNKALPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVMHEALHNHYTQ KSLSLSPGKRK | 134 |
| Construct 130 | MPRLFFFHLLGVCLLLNQFSRAVADSWMEEVIKLCGRELVRAQI AICGMSTWSGSTDSGSDTSSGNSGDGNSGQLYSALANKCCHVGC TKRSLARFCEPKSSDKTHTSPPSPAPELLGGSSVFLFPPKPKDTLYI TREPEVTCVVVDVSHEDPEVKFNWYVDGVEVHNAKTKPREEQY NSTYRVVSVLTVLHQDWLNGKEYKCKVSNKALPAPIEKTISKAK GQPREPQVYTLPPSRDELTKNQVSLTCLVKGFYPSDIAVEWESNG QPENNYKTTPPVLDSDGSFFLYSKLTVDKSRWQQGNVFSCSVMH EALHNHYTQKSLSLSPGKRK | 135 |
| Construct 131 | MPRLFFFHLLGVCLLLNQFSRAVADSWMEEVIKLCGRELVRAQI AICGMSTWSGSTDSGSDTSSGNSGDGNSGQLYSALANKCCHVGC TKRSLARFCGSTDSGSDTSSGNSGDGNSGEPKSSDKTHTSPPSPAP ELLGGSSVFLFPPKPKDTLYITREPEVTCVVVDVSHEDPEVKFNW YVDGVEVHNAKTKPREEQYNSTYRVVSVLTVLHQDWLNGKEY KCKVSNKALPAPIEKTISKAKGQPREPQVYTLPPSRDELTKNQVS LTCLVKGFYPSDIAVEWESNGQPENNYKTTPPVLDSDGSFFLYSK LTVDKSRWQQGNVFSCSVMHEALHNHYTQKSLSLSPGKRK | 136 |
| Construct 132 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGSTDSGSDTSSGNSGDGNSGEPKSSDKTHTSPPSPAPELL GGSSVFLFPPKPKDTLYITREPEVTCVVVDVSHEDPEVKFNWYVD GVEVHNAKTKPREEQYNSTYRVVSVLTVLHQDWLNGKEYKCK VSNKALPAPIEKTISKAKGQPREPQVYTLPPSRDELTKNQVSLTCL VKGFYPSDIAVEWESNGQPENNYKTTPPVLDSDGSFFLYSKLTVD KSRWQQGNVFSCSVMHEALHNHYTQKSLSLSPGKRK | 137 |
| Construct 133 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKREPKSSDKTHTSPPSPAPELL GGSSVFLFPPKPKDTLYITREPEVTCVVVDVSHEDPEVKFNWYVD GVEVHNAKTKPREEQYNSTYRVVSVLTVLHQDWLNGKEYKCK VSNKALPAPIEKTISKAKGQPREPQVYTKPPSRDELTKNQVSLSCL VKGFYPSDIAVEWESNGQPENNYKTTVPVLDSDGSFRLASYLTV DKSRWQQGNVFSCSVMHEALHNHYTQKSLSLSPGKRKGSTDSG SDTSSGNSGDGNSGQLYSALANKCCHVGCTKRSLARFC | 138 |
| Construct 134 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKREVQLLESGGGLVQPGGSLR LSCAASGFTFSSYAMSWVRQAPGKGLEWVSAISGSGGSTYYADS VKGRFTISRDNSKNTLYLQMNSLRAEDTAVYYCTKDPPRYHYTG LAVRGQGTTVTVSSGSTDSGSDTSSGNSGDGNSGQLYSALANKC CHVGCTKRSLARFC | 139 |
| Construct 135 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKREPKSSDKTHTSPPSPAPELL GGSSVFLFPPKPKDTLYITREPEVTCVVVDVSHEDPEVKFNWYVD GVEVHNAKTKPREEQYNSTYRVVSVLTVLHQDWLNGKEYKCK VSNKALPAPIEKTISKAKGQPREPQVYTLPPSRDELTKNQVSLTCL VKGFYPSDIAVEWESNGQPENNYKTTPPVLDSDGSFFLYSKLTVD KSRWQQGNVFSCSVMHEALHNHYTQKSLSLSPGKRKGSTDSGS DTSSGNSGDGNSGQLYSALANKCCHVGCTKRSLARFC | 140 |

TABLE 5-continued

Amino Acid Sequences

| | Sequence | SEQ ID NO: |
|---|---|---|
| Construct 136 | MPRLFFFHLLGVCLLLNQFSRAVADSWMEEVIKLCGRELVRAQI<br>AICGMSTWSKRSLSQEDAPQTPRPVAEIVPSFINKDTETINMMSEF<br>VANLPQELKLTLSEMQPALPQLQQHVPVLKDSSLLFEEFKKLIRN<br>RQSEAADSSPSELKYLGLDTHSRKKRQLYSALANKCCHVGCTKR<br>SLARFCGSTDSGSDTSSGNSGDGNSGEPKSSDKTHTSPPSPAPELL<br>GGSSVFLFPPKPKDTLYITREPEVTCVVVDVSHEDPEVKFNWYVD<br>GVEVHNAKTKPREEQYNSTYRVVSVLTVLHQDWLNGKEYKCK<br>VSNKALPAPIEKTISKAKGQPREPQVYTKPPSRDELTKNQVSLSCL<br>VKGFYPSDIAVEWESNGQPENNYKTTVPVLDSDGSFRLASYLTV<br>DKSRWQQGNVFSCSVMHEALHNHYTQKSLSLSPGKRK | 141 |
| Construct 137 | MPRLFFFHLLGVCLLLNQFSRAVADSWMEEVIKLCGRELVRAQI<br>AICGMSTWSKRSLSQEDAPQTPRPVAEIVPSFINKDTETINMMSEF<br>VANLPQELKLTLSEMQPALPQLQQHVPVLKDSSLLFEEFKKLIRN<br>RQSEAADSSPSELKYLGLDTHSRKKRQLYSALANKCCHVGCTKR<br>SLARFCGSTDSGSDTSSGNSGDGNSGEVQLLESGGGLVQPGGSLR<br>LSCAASGFTFSSYAMSWVRQAPGKGLEWVSAISGSGGSTYYADS<br>VKGRFTISRDNSKNTLYLQMNSLRAEDTAVYYCTKDPPRYHYTG<br>LAVRGQGTTVTVSS | 142 |
| Construct 138 | MPRLFFFHLLGVCLLLNQFSRAVADSWMEEVIKLCGRELVRAQI<br>AICGMSTWSGSTDSGSDTSSGNSGDGNSGEPKSSDKTHTSPPSPA<br>PELLGGSSVFLFPPKPKDTLYITREPEVTCVVVDVSHEDPEVKFN<br>WYVDGVEVHNAKTKPREEQYNSTYRVVSVLTVLHQDWLNGKE<br>YKCKVSNKALPAPIEKTISKAKGQPREPQVYTKPPSRDELTKNQV<br>SLSCLVKGFYPSDIAVEWESNGQPENNYKTTVPVLDSDGSFRLAS<br>YLTVDKSRWQQGNVFSCSVMHEALHNHYTQKSLSLSPGKRKKR<br>SLSQEDAPQTPRPVAEIVPSFINKDTETINMMSEFVANLPQELKLT<br>LSEMQPALPQLQQHVPVLKDSSLLFEEFKKLIRNRQSEAADSSPSE<br>LKYLGLDTHSRKKRQLYSALANKCCHVGCTKRSLARFC | 143 |
| Construct 139 | MPRLFFFHLLGVCLLLNQFSRAVADSWMEEVIKLCGRELVRAQI<br>AICGMSTWSGSTDSGSDTSSGNSGDGNSGQLYSALANKCCHVGC<br>TKRSLARFCGSTDSGSDTSSGNSGDGNSGEVQLLESGGGLVQPG<br>GSLRLSCAASGFTFSSYAMSWVRQAPGKGLEWVSAISGSGGSTY<br>YADSVKGRFTISRDNSKNTLYLQMNSLRAEDTAVYYCTKDPPRY<br>HYTGLAVRGQGTTVTVSS | 144 |
| Construct 140 | MPRLFFFHLLGVCLLLNQFSRAVADSWMEEVIKLCGRELVRAQI<br>AICGMSTWSGSTDSGSDTSSGNSGDGNSGQLYSALANKCCHVGC<br>TKRSLARFCGSTDSGSDTSSGNSGDGNSGEPKSSDKTHTSPPSPAP<br>ELLGGSSVFLFPPKPKDTLYITREPEVTCVVVDVSHEDPEVKFNW<br>YVDGVEVHNAKTKPREEQYNSTYRVVSVLTVLHQDWLNGKEY<br>KCKVSNKALPAPIEKTISKAKGQPREPQVYTKPPSRDELTKNQVS<br>LSCLVKGFYPSDIAVEWESNGQPENNYKTTVPVLDSDGSFRLASY<br>LTVDKSRWQQGNVFSCSVMHEALHNHYTQKSLSLSPGKRK | 145 |
| Construct 141 | MPRLFFFHLLGVCLLLNQFSRAVADSWMEEVIKLCGRELVRAQI<br>AICGMSTWSKRSLSQEDAPQTPRPVAEIVPSFINKDTETINMMSEF<br>VANLPQELKLTLSEMQPALPQLQQHVPVLKDSSLLFEEFKKLIRN<br>RQSEAADSSPSELKYLGLDTHSRKKRQLYSALANKCCHVGCTKR<br>SLARFC | 146 |
| Construct 142 | MPRLFFFHLLGVCLLLNQFSRAVADSWMEEVIKLCGRELVRAQI<br>AICGMSTWSKRSLSQEDAPQTPRPVAEIVPSFINKDTETINMMSEF<br>VANLPQELKLTLSEMQPALPQLQQHVPVLKDSSLLFEEFKKLIRN<br>RQSEAADSSPSELKYLGLDTHSRKKRQLYSALANKCCHVGCTKR<br>SLARFCGGGGSGGGGSGGGGSDIQMTQSPSSLSASVGDRVTITCR<br>ASRPIGTMLSWYQQKPGKAPKLLILAFSRLQSGVPSRFSGSGSGT<br>DFTLTISSLQPEDFATYYCAQAGTHPTTFGQGTKVEIKR | 147 |
| Construct 143 | MPRLFFFHLLGVCLLLNQFSRAVADSWMEEVIKLCGRELVRAQI<br>AICGMSTWSKRSLSQEDAPQTPRPVAEIVPSFINKDTETINMMSEF<br>VANLPQELKLTLSEMQPALPQLQQHVPVLKDSSLLFEEFKKLIRN<br>RQSEAADSSPSELKYLGLDTHSRKKRQLYSALANKCCHVGCTKR<br>SLARFCGGGGSGGGGSGGGGSDIQMTQSPSSLSASVGDRVTITCR<br>ASRPIGTMLSWYQQKPGKAPKLLILAFSRLQSGVPSRFSGSGSGT<br>DFTLTISSLQPEDFATYYCAQAGTHPTTFGQGTKVEIKR | 148 |
| Construct 144 | MPRLFFFHLLGVCLLLNQFSRAVADSWMEEVIKLCGRELVRAQI<br>AICGMSTWSKRSLSQEDAPQTPRPVAEIVPSFINKDTETINMMSEF<br>VANLPQELKLTLSEMQPALPQLQQHVPVLKDSSLLFEEFKKLIRN<br>RQSEAADSSPSELKYLGLDTHSRKKRQLYSALANKCCHVGCTKR<br>SLARFCGGGGSGGGGSGGGGSDIQMTQSPSSLSASVGDRVTITCR | 149 |

TABLE 5-continued

Amino Acid Sequences

| | Sequence | SEQ ID NO: |
|---|---|---|
| | ASRPIGTMLSWYQQKPGKAPKLLILAFSRLQSGVPSRFSGSGSGT DFTLTISSLQPEDFATYYCAQAGTHPTTFGQGTKVEIKR | |
| Construct 145 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 150 |
| Construct 146 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 151 |
| Construct 147 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 152 |
| Construct 148 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 153 |
| Construct 149 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 154 |
| Construct 150 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 155 |
| Construct 151 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 156 |
| Construct 152 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 157 |
| Construct 153 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 158 |

TABLE 5-continued

Amino Acid Sequences

| | Sequence | SEQ ID NO: |
|---|---|---|
| Construct 154 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 159 |
| Construct 155 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 160 |
| Construct 156 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 161 |
| Construct 157 | MPRLFFFHLLGVCLLLNQFSRAVADSWMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFCGGGGSGGGGSGGGGSDIQMTQSPSSLSASVGDRVTITCR ASRPIGTMLSWYQQKPGKAPKLLILAFSRLQSGVPSRFSGSGSGT DFTLTISSLQPEDFATYYCAQAGTHPTTFGQGTKVEIKR | 162 |
| Relaxin 2 [Homo sapiens] (AA126416.1) | <u>MPRLFFFHLLGVCLLLNQFSRAVADS</u>WMEEVIKLCGRELVRAQI AICGMSTWSKRSLSQEDAPQTPRPVAEIVPSFINKDTETINMMSEF VANLPQELKLTLSEMQPALPQLQQHVPVLKDSSLLFEEFKKLIRN RQSEAADSSPSELKYLGLDTHSRKKRQLYSALANKCCHVGCTKR SLARFC | 1 |
| RLN2, Prorelaxin H2, isoform 2 | <u>MPRLFFFHLLGVCLLLNQFSRAVADS</u>WMEEVIKLCGRELVRAQI AICGMSTWSKRSLSQEDAPQTPRPVAGDFIQTVSLGISPDGGKAL RTGSCFTREFLGALSKLCHPSSTKIQKP | 3 |

Underline indicates signal sequence

TABLE 6

DNA Sequences

| Name | ORF Sequence | 5' UTR | 3' UTR | SEQ ID NO: |
|---|---|---|---|---|
| Construct 1 | ATGCCCCGCCTGTTCTTCTTCCACCTCCTTGGC GTGTGCCTCCTCCTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCA AGCGCTCCCTCTCCCAGGAGGACGCCCCACAG ACCCCGCGCCCCGTCGCCGAGATCGTCCCCTC CTTCATCAACAAGGACACCGAGACGATCAAC ATGATGTCCGAGTTCGTCGCCAACCTGCCGCA GGAGCTCAAGCTCACCCTCTCCGAGATGCAGC CCGCCCTCCCGCAGCTCCAGCAGCACGTCCCC GTCCTCAAGGACTCCTCCCTCCTCTTCGAGGA GTTCAAGAAGCTCATCCGCAACCGCCAGTCCG AGGCCGCCGACTCCAGCCCCTCCGAGCTGAAG TACCTCGGCCTCGACACCCACTCCCGCAAGAA GCGCCAGCTCTACTCCGCCCTCGCCAACAAGT GCTGCCACGTCGGCTGCACCAAGCGGTCCCTG GCCCGCTTCTGCGGAGGCGGCGGCTCTGGCGG | 5' UTR 1 | 3' UTR 1 | 163 |

TABLE 6-continued

DNA Sequences

| Name | ORF Sequence | 5' UTR | 3' UTR | SEQ ID NO: |
|---|---|---|---|---|
| | TGGTGGATCCGGCGGCGGTGGCAGCGACATC CAGATGACCCAGTCCCCATCCAGCCTGAGCGC CTCCGTCGGCGACCGCGTCACCATCACCTGCC GCGCCTCCCGCCCCATCGGCACCATGCTCTCC TGGTACCAGCAGAAGCCCGGCAAGGCCCCGA AGCTCCTCATCCTCGCCTTCTCCCGCCTCCAGT CCGGCGTCCCGTCAAGGTTCTCCGGCTCGGGC TCCGGTACCGACTTCACCCTCACCATCTCCTC GCTCCAGCCAGAGGACTTCGCCACCTACTACT GCGCCCAGGCCGGCACCCACCCCACCACCTTC GGCCAGGGCACCAAGGTCGAGATCAAGCGC | | | |
| Construct 2 | ATGCCCAGACTGTTCTTCTTCCACCTCCTCGGC GTGTGCCTCCTCCTTAACCAGTTCAGCCGGGC CGTGGCCGACAGCTGGATGGAGGAGGTGATC AAGCTATGCGGCCGGGAGCTCGTGCGGGCCC AGATCGCCATCTGCGGCATGAGCACCTGGAGC AAGCGGAGCCTGAGCCAGGAGGACGCCCCTC AGACCCCGCGGCCAGTGGCCGAGATCGTGCC CAGCTTCATCAACAAGGACACCGAGACAATC AACATGATGAGCGAGTTCGTGGCCAACCTGCC CCAGGAGCTGAAGCTGACCCTGAGCGAGATG CAGCCCGCCCTGCCGCAGCTGCAGCAGCACGT GCCCGTGCTGAAGGACAGCAGCCTGCTGTTCG AGGAGTTCAAGAAGCTGATCCGGAACCGGCA GAGCGAGGCCGCCGACTCCAGCCCCAGCGAA CTGAAGTACCTGGGCCTGGACACCCACAGCCG GAAGAAGCGGCAGCTGTACAGCGCCCTGGCC AACAAGTGCTGCCACGTGGGCTGCACCAAGC GATCCCTGGCCCGGTTCTGCGGCGGCGGAGGC AGCGGCGGTGGCGGAAGCGGAGGCGGCGGCA GCGACATCCAGATGACCCAGAGCCCCAAGCTC CCTGTCCGCCAGCGTGGGCGACCGGGTGACCA TCACCTGCCGGGCCAGCCGGCCCATCGGCACC ATGCTGAGCTGGTACCAGCAGAAGCCCGGCA AGGCCCCGAAGCTGCTGATCCTGGCCTTCTCC AGGCTGCAGAGCGGCGTGCCGAGCCGGTTCA GCGGCTCCGGCAGCGGAACCGACTTCACCCTG ACCATCTCAAGCCTGCAGCGGAGGACTTCGC CACCTACTACTGCGCCCAGGCCGGCACCCACC CCACCACCTTCGGCCAGGGCACCAAGGTGGA GATCAAGCGG | 5' UTR 1 | 3' UTR 1 | 164 |
| Construct 3 | ATGCCTCGCCTGTTTTTTTTCCACCTGCTAGGA GTCTGTTTACTACTGAACCAATTTTCCAGAGC AGTCGCGGACTCATGGATGAGGAAGTTATTA AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGAAATTGTGCCATCC TTCATCAACAAAGATACAGAAACCATAAATAT GATGTCAGAATTTGTTGCTAATTTGCCACAGG AGCTGAAGTTAACCCTGTCTGAGATGCAGCCA GCATTACCACAGCTACAACAACATGTACCTGT ATTAAAAGATTCCAGTCTTCTCTTTGAAGAAT TTAAGAAACTTATTCGCAATAGACAAAGTGAA GCCGCAGACAGCAGTCCTTCAGAATTAAAATA CTTAGGCTTGGATACTCATTCTCGAAAAAAGA GACAACTCTACAGTGCATTGGCTAATAAATGT TGCCATGTTGGTTGTACCAAAAGATCTCTTGC TAGATTTTGC | 5' UTR 1 | 3' UTR 4 | 165 |
| Construct 4 | ATGCCTAGGCTCTTTTTCTTCCACTTGCTAGGG GTGTGCTTGTTGTTAAACCAGTTTAGTAGAGC GGTCGCCGATTCTTGGATGGAGGAAGTGATAA AGCTCTGTGGGCGGAATTAGTCCGCGCACAA ATTGCCATATGCGGAATGGGTGGGGGCGGTA GTGGCGGAGGAGGTTCCGGGGAGGAGGGAG CGGCGGAGGAGGGCTCAGGCGGCGGAGGAAGT GGTGGCGGTGGCTCAGGTGGCGGAGGATCTG GGGGCGGCGGAAGCGGCGGAGGAGGATCTGG GGGCGGTGGAAGTGGCGGAGGTGGGTCTGGC GGGGAGGGAGTGGCGGGGGCGGTTCCGGGG GTGGAGGCAGCGGAGGCGGTGGCTCCGGGGG | 5' UTR 1 | 3' UTR 2 | 166 |

TABLE 6-continued

DNA Sequences

| Name | ORF Sequence | 5' UTR | 3' UTR | SEQ ID NO: |
|---|---|---|---|---|
| | GGGTGGTTCCGGTGGTGGCGGGTCAGGAGGA<br>GGGGGGTCAGGCGGCGGAGGATCCGGCGGCG<br>GCGGCTCCCAACTTTATTCGGCTCTGGCTAAT<br>AAATGCTGTCACGTGGGCTGCACCAAACGTTC<br>GCTTGCGCGGTTTTGT | | | |
| Construct 5 | ATGCCTCGACTGTTTTTCTTTCACCTCCTAGGA<br>GTCTGCTTACTTCTCAACCAGTTCAGTAGGGC<br>AGTCGCGGACTCATGGATGGAAGAGGTTATTA<br>AATTATGTGGCCGTGAATTGGTGCGTGCACAA<br>ATAGCTATTTGCGGCATGGGCGGTGGCGGCTC<br>TGGTGGCGGCGGCTCTGGAGGGGGCGGAAGT<br>GGTGGAGGAGGTAGTGGCGGAGGTGGATCGG<br>GAGGCGGAGGATCTGGAGGGGGGGGCTCCTT<br>TCAAAGCTCCTCGAGCAAAGCGCCCCCTCCCA<br>GCCTGCCCAGCCCTAGTAGGCTGCCCGGTCCG<br>AGCGACACGCCCATCCTGCCCCAGGGTGGCG<br>GTGGCTCTGGGGGTGGCGGTTCAGGCGGAGG<br>TGGTTCTGGCGGAGGCGGATCAGGTGGTGGG<br>GGATCCGGCGGCGGCGATCTGGTGGCGGGG<br>GGAGTCAGCTCTACTCTGCGTTGGCCAATAAA<br>TGCTGCCATGTTGGTTGTACAAAAAGATCTTT<br>GGCTAGATTTTGC | 5' UTR 1 | 3' UTR 2 | 167 |
| Construct 6 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGGAGCCCAAGAGCAG<br>CGACAAGACCCACACCAGCCCCCCCAGCCCCC<br>GCCCCCGAGCTGCTGGGCGGCAGCAGCGTGTT<br>CCTGTTCCCCCCCAAGCCCAAGGACACCCTGT<br>ACATCACCAGGGAGCCCGAGGTGACCTGCGT<br>GGTGGTGGACGTGAGCCACGAGGACCCCGAG<br>GTGAAGTTCAACTGGTACGTGGACGGCGTGG<br>AGGTGCACAACGCCAAGACCAAGCCCAGGGA<br>GGAGCAGTACAACAGCACCTACAGGGTGGTG<br>AGCGTGCTGACCGTGCTGCACCAGGACTGGCT<br>GAACGGCAAGGAGTACAAGTGCAAGGTGAGC<br>AACAAGGCCCTGCCCGCCCCCATCGAGAAGA<br>CCATCAGCAAGGCCAAGGGCCAGCCCAGGGA<br>GCCCCAGGTGTACACCCTGCCCCCCAGCAGGG<br>ACGAGCTGACCAAGAACCAGGTGAGCCTGAC<br>CTGCCTGGTGAAGGGCTTCTACCCCAGCGACA<br>TCGCCGTGGAGTGGGAGAGCAACGGCCAGCC<br>CGAGAACAACTACAAGACCACCCCCCCCGTG<br>CTGGACAGCGACGGCAGCTTCTTCCTGTACAG<br>CAAGCTGACCGTGGACAAGAGCAGGTGGCAG<br>CAGGGCAACGTGTTCAGCTGCAGCGTGATGCA<br>CGAGGCCCTGCACAACCACTACACCCAGAAG<br>AGCCTGAGCCTGAGCCCCGGCAAGAGGAAGA<br>GCACCTGGAGCAAAAGGTCTCTGAGCCAGGA<br>AGATGCTCCTCAGACACCTAGACCAGTGGCAG<br>AAATTGTGCCATCCTTCATCAACAAAGATACA<br>GAAACCATAAATATGATGTCAGAATTTGTTGC<br>TAATTTGCCACAGGAGCTGAAGTTAACCCTGT<br>CTGAGATGCAGCCAGCATTACCACAGCTACAA<br>CAACATGTACCTGTATTAAAAGATTCCAGTCT<br>TCTCTTTGAAGAATTTAAGAAACTTATTCGCA<br>ATAGACAAAGTGAAGCCGCAGACAGCAGTCC<br>TTCAGAATTAAAATACTTAGGCTTGGATACTC<br>ATTCTCGAAAAAAGAGACAACTCTACAGTGC<br>ATTGGCTAATAAATGTTGCCATGTTGGTTGTA<br>CCAAAAGATCTCTTGCTAGATTTTGC | 5' UTR 1 | 3' UTR 2 | 168 |
| Construct 7 | ATGCCCAGGCTGTTCTTCTTCCACCTGCTGGG<br>AGTGTGCCTCCTGCTGAACCAGTTCAGCCGCG<br>CCGTGGCCGACAGCTGGATGGAGGAGGTGAT<br>CAAGCTGTGCGGGAGGGAGCTGGTCCGAGCC<br>CAAATCGCCATCTGCGGGATGTCCACCTGGAG<br>CAAGAGAAGCCTGTCCCAGGAGGATGCCCCC<br>CAAACGCCCAGGCCCGTGGCCGAGATCGTGC<br>CCAGCTTCATCAACAAGGACACCGAGACCATC<br>AACATGATGTCCGAGTTCGTGGCCAACCTGCC | 5' UTR 1 | 3' UTR 4 | 169 |

TABLE 6-continued

DNA Sequences

| Name | ORF Sequence | 5' UTR | 3' UTR | SEQ ID NO: |
|---|---|---|---|---|
| | CCAGGAGCTGAAGCTGACCCTGTCCGAGATGC AGCCAGCCCTCCCCCAGCTGCAGCAGCACGTG CCCGTGTTGAAGGACAGCAGCCTGCTGTTCGA GGAGTTCAAAAAGCTGATACGCAACAGGCAG AGCGAGGCGGCCGACAGCTCCCCGTCGGAGC TGAAGTACCTGGGGCTGGACACCCACAGCCG GAAGAAGCGGCAGCTGTACAGCGCACTGGCC AACAAATGTTGCCACGTGGGCTGCACCAAGA GGAGCCTGGCCAGGTTCTGC | | | |
| Construct 8 | ATGCCCAGGCTGTTCTTCTTCCACCTCCTGGGT GTGTGCCTGCTGCTGAACCAGTTTAGCAGGGC CGTGGCCGACAGCTGGATGGAGGAGGTGATC AAGCTGTGCGGCAGGGAGCTCGTGCGAGCGC AGATCGCCATCTGCGGCATGAGCACCTGGAGT AAGAGGAGCCTCTCCCAGGAGGACGCCCCCC AGACGCCACGCCCGGTGGCGGAGATCGTGCC CTCCTTCATCAACAAGGACACAGAGACCATCA ACATGATGAGCGAGTTTGTGGCCAACCTGCCC CAGGAACTTAAGCTGACCCTCAGCGAGATGC AGCCGGCCCTTCCCCAGCTGCAGCAGCACGTG CCCGTGCTGAAGGACAGCAGCCTGCTGTTCGA GGAGTTCAAAAAGCTGATCCGCAATAGGCAG AGCGAGGCCGCCGACTCCAGCCCCAGCGAGC TGAAGTATCTGGGCCTGGACACCCACAGCAG GAAGAAACGGCAGCTGTACAGCGCGCTGGCG AACAAGTGCTGCCACGTGGGCTGCACCAAGA GGTCGCTCGCCAGGTTCTGC | 5' UTR 1 | 3' UTR 4 | 170 |
| Construct 9 | ATGCCCAGGCTGTTCTTCTTTCACCTGCTGGGC GTGTGTCTGCTGCTCAACCAGTTTAGCCGCGC CGTGGCCGACAGCTGGATGGAGGAGGTCATA AAGCTGTGCGGGAGGGAACTGGTGAGGGCCC AGATCGCCATCTGCGGAATGTCCACCTGGAGC AAGAGGAGCCTGAGCCAGGAGGACGCCCCAC AGACTCCGCGGCCCGGTTGCGGAGATCGTGCCC TCCTTCATCAATAAAGATACCGAGACCATCAA CATGATGTCCGAGTTCGTGGCCAACCTGCCGC AGGAGCTGAAACTCACCCTCAGCGAGATGCA GCCCGCGCTGCCCCAGCTGCAGCAGCACGTGC CCGTGCTGAAGGACAGCAGCCTGCTGTTTGAA GAATTCAAAAAACTGATCCGGAACCGACAGA GCGAGGCCGCCGACTCCAGCCCCAGCGAACT GAAGTACCTGGGGCTGGACACCCACAGCCGG AAAAAGCGGCAGCTGTACAGCGCACTGGCCA ATAAGTGTTGCCACGTCGGCTGCACGAAGCGG TCCCTTGCCCGCTTCTGC | 5' UTR 1 | 3' UTR 4 | 171 |
| Construct 10 | ATGCCCCGCCTGTTCTTCTTTCACCTGCTGGGC GTGTGCCTGCTGCTGAACCAGTTCAGCAGGGC CGTGGCCGACAGCTGGATGGAAGAGGTGATC AAGCTCTGCGGCAGGGAACTGGTGAGGGCCC AGATCGCCATCTGCGGCATGTCCACCTGGTCC AAAAGGAGCCTCAGCCAGGAGGACGCCCCCC AGACCCCCGGCCAGTGGCCGAGATCGTGCCC TCCTTCATCAACAAGGACACCGAGACTATCAA CATGATGTCCGAGTTCGTGGCCAACCTGCCCC AGGAGCTGAAGCTGACCCTGAGCGAAATGCA GCCCGCGCTGCCCCAGCTGCAACAGCACGTGC CCGTGCTGAAGGACAGCAGCCTGCTGTTTGAG GAGTTCAAGAAGCTGATCCGCAACAGGCAGA GCGAGGCCGCCGACTCCAGCCCCAGCGAACT GAAATATCTGGGGCTGGACACCCACTCCCGGA AGAAGAGGCAGCTGTACAGCGCCCTGGCCAA CAAATGCTGCCACGTGGGGTGCACGAAGCGG TCCCTGGCCCGCTTTTGC | 5' UTR 1 | 3' UTR 4 | 172 |
| Construct 11 | ATGCCCAGGCTGTTTTTCTTCCACCTCCTGGGC GTGTGCCTGCTGCTGAATCAGTTTTCCCGGGC CGTGGCCGACAGCTGGATGGAGGAGGTGATC AAGCTGTGTGGCCGGGAGCTGGTTCGGGCCCA GATAGCCATCTGTGGAATGAGCACCTGGAGC AAGCGGAGCCTGTCCCAGGAGGACGCCCCCC AGACACCCCGGCCGGTGGCCGAAATCGTCCCC | 5' UTR 1 | 3' UTR 4 | 173 |

TABLE 6-continued

DNA Sequences

| Name | ORF Sequence | 5' UTR | 3' UTR | SEQ ID NO: |
|---|---|---|---|---|
| | AGCTTCATCAACAAGGACACCGAGACCATCA<br>ACATGATGAGCGAGTTCGTGGCCAACCTGCCC<br>CAGGAGCTGAAGCTGACGCTGAGCGAGATGC<br>AGCCTGCCCTGCCCCAGCTGCAACAGCACGTG<br>CCTGTGCTGAAGGACAGCAGCCTCCTGTTCGA<br>GGAGTTCAAGAAGCTCATCAGGAACCGGCAG<br>AGCGAGGCCGCTGACAGCTCACCCAGCGAGC<br>TGAAGTACCTGGGCCTGGACACCCACTCGAGG<br>AAGAAGCGGCAGCTGTACAGCGCGCTGGCCA<br>ACAAGTGTTGCCATGTGGGCTGTACCAAGAGG<br>AGCCTGGCCAGGTTCTGC | | | |
| Construct 12 | ATGCCCCGACTGTTCTTTTTCCACCTGCTGGGG<br>GTGTGCCTGCTGCTGAACCAGTTTTCGAGGGC<br>GGTGGCGGACAGTTGGATGGAGGAGGTCATC<br>AAGCTCTGCGGGAGGGAGCTCGTCAGGGCCC<br>AGATCGCCATCTGCGGCATGTCCACCTGGAGC<br>AAGCGTTCGCTGTCCCAGGAGGACGCCCCCCA<br>GACCCCGAGACCCGTGGCCGAGATCGTGCCC<br>AGCTTCATCAACAAGGATACCGAAACCATCA<br>ACATGATGAGCGAGTTTGTGGCCAACCTCCCG<br>CAGGAGCTCAAGCTCACGCTGAGCGAGATGC<br>AGCCGGCCCTGCCCCAGCTGCAGCAGCATGTC<br>CCCGTCCTGAAGGACAGCAGCCTGCTGTTCGA<br>GGAGTTCAAGAAACTGATCCGGAACCGGCAG<br>AGCGAGGCCGCCGATAGCAGCCCCAGCGAGC<br>TGAAGTACCTGGGGCTGGACACCCACAGTCGC<br>AAGAAGCGGCAGCTGTACAGCGCCCTGGCCA<br>ACAAGTGTTGCCACGTCGGGTGTACGAAGCGC<br>TCCCTGGCCAGATTCTGC | 5' UTR 1 | 3' UTR 4 | 174 |
| Construct 13 | ATGCCCCGGCTGTTCTTTTTCCACCTGCTGGGC<br>GTGTGCCTGCTGCTGAACCAGTTCAGCCGAGC<br>CGTCGCAGATTCCTGGATGGAGGAGGTGATCA<br>AGCTGTGCGGCCGGGAGCTCGTGAGGGCCCA<br>GATCGCCATTTGCGGCATGTCCACCTGGAGCA<br>AGCGGAGCCTGAGCCAGGAGGACGCGCCGCA<br>GACTCCCCGGCCCGTGGCCGAAATCGTGCCCT<br>CCTTCATCAATAAGGACACCGAAACCATAAAC<br>ATGATGAGCGAGTTTGTGGCCAACCTGCCACA<br>GGAGCTGAAACTGACGCTGAGCGAGATGCAG<br>CCCGCGCTGCCCCAGCTGCAGCAGCATGTGCC<br>CGTGCTGAAGGACAGCAGCCTGCTGTTCGAGG<br>AATTTAAGAAGCTAATCCGGAACAGGCAGAG<br>CGAGGCCGCCGACAGCTCCCCGAGCGAGCTG<br>AAGTACCTCGGGCTGGACACCCACAGCCGGA<br>AGAAGCGGCAACTGTACAGCGCCCTGGCGAA<br>CAAGTGCTGCCACGTGGGCTGTACCAAAAGA<br>AGCCTCGCCCGCTTCTGC | 5' UTR 1 | 3' UTR 4 - | 175 |
| Construct 14 | ATGCCTAGGCTCTTCTTCTTCCACCTGCTGGGC<br>GTCTGCCTGCTGCTGAACCAATTCAGCCGGGC<br>CGTAGCCGACTCCTGGATGGAGGAGGTGATC<br>AAACTGTGCGGGAGGGAGCTGGTGAGGGCCC<br>AAATCGCGATCTGCGGCATGTCCACCTGGAGC<br>AAGCGGAGCCTGTCGCAGGAAGATGCCCCCC<br>AGACCCCCAGGCCGGTGGCCGAGATCGTCCCC<br>AGCTTCATCAACAAGGATACCGAGACCATAA<br>ACATGATGAGCGAGTTTGTGGCCAACCTCCCC<br>CAGGAGCTGAAGCTGACCCTCAGCGAGATGC<br>AGCCCGCCCTGCCGCAGCTGCAACAGCACGTG<br>CCCGTGCTGAAGGACAGCAGCCTGCTGTTCGA<br>AGAGTTCAAGAAGCTGATCCGGAACCGGCAG<br>AGCGAGGCCGCCGACAGCTCCCCCTCCGAGCT<br>GAAGTACCTGGGCCTGGACACGCACAGCCGG<br>AAGAAGCGGCAGCTGTACAGCGCACTGGCCA<br>ACAAGTGCTGTCACGTCGGCTGCACCAAGCGT<br>AGCCTGGCCAGATTCTGC | 5' UTR 1 | 3' UTR 4 | 176 |
| Construct 15 | ATGCCCAGGCTGTTCTTCTTCCACCTGCTGGG<br>CGTGTGCCTGCTGCTCAACCAGTTCAGCAGGG<br>CCGTGGCCGACAGCTGGATGGAGGAGGTGAT<br>CAAACTGTGCGGGAGGGAGCTGGTGAGGGCG<br>CAGATCGCCATCTGCGGCATGAGCACCTGGAG | 5' UTR 1 | 3' UTR 4 | 177 |

TABLE 6-continued

DNA Sequences

| Name | ORF Sequence | 5' UTR | 3' UTR | SEQ ID NO: |
|---|---|---|---|---|
| | CAAGAGGAGCCTCAGCCAGGAGGACGCCCCC CAGACCCCCAGGCCCGTGGCCGAGATCGTGCC CAGCTTCATCAACAAGGACACCGAAACCATC AACATGATGAGCGAGTTCGTGGCCAACCTGCC CCAGGAGCTCAAGCTGACCCTCAGCGAGATG CAACCCGCCCTGCCCCAGCTGCAGCAGCACGT GCCCGTGCTGAAGGACAGCAGCCTGCTGTTCG AGGAGTTCAAGAAGCTGATCCGTAACAGGCA GAGCGAGGCCGCCGACTCCAGCCCCAGCGAG CTGAAGTACCTGGGCCTGGACACCCACTCCCG GAAGAAGAGGCAGCTGTACAGTGCGCTGGCC AACAAATGTTGCCATGTGGGCTGCACCAAGCG GAGCCTGGCCCGCTTCTGC | | | |
| Construct 16 | ATGCCCAGGCTGTTCTTTTTCCACCTGCTGGG GGTCTGCCTCCTGCTGAACCAGTTCTCCAGGG CGGTCGCCGACAGCTGGATGGAAGAGGTCAT CAAGCTGTGCGGGAGGGAGCTGGTCAGGGCC CAGATCGCCATCTGTGGCATGTCCACCTGGAG CAAGAGGAGCCTGAGCCAGGAGGACGCGCCG CAGACGCCCCGTCCCGTGGCGGAGATAGTGCC GAGCTTCATCAACAAGGACACCGAGACTATC AACATGATGAGCGAGTTCGTGGCCAACCTCCC TCAGGAGCTGAAGCTGACCCTGAGCGAGATG CAGCCCGCCCTCCCCCAGCTGCAACAGCACGT GCCCGTGCTGAAGGACAGCAGCCTCCTGTTCG AGGAGTTCAAGAAGCTGATCCGGAATAGGCA GAGCGAGGCCGCCGATAGCTCGCCCAGCGAG CTTAAGTACCTGGGCCTCGACACACACAGCAG GAAGAAGAGGCAGCTGTACAGCGCCCTGGCC AACAAGTGTTGCCACGTCGGCTGCACTAAGCG GAGCCTCGCTAGGTTCTGC | 5' UTR 1 | 3' UTR 4 | 178 |
| Construct 17 | ATGCCCCGACTGTTCTTCTTCCATCTGCTGGGC GTGTGCCTCCTGCTGAATCAATTCAGCAGGGC CGTGGCCGACTCCTGGATGGAGGAGGTCATCA AGCTGTGCGGCAGGGAACTGGTGAGGGCGCA GATCGCCATCTGCGGCATGTCCACTTGGAGCA AGAGGTCGCTGTCGCAGGAGGACGCCCCCCA GACCCCGAGGCCCGTGGCCGAGATCGTGCCC AGCTTCATCAACAAGGACACCGAGACCATCA ATATGATGTCCGAGTTCGTGGCCAACCTCCCT CAGGAGCTGAAGCTGACCCTGTCCGAGATGC AGCCCGCCCTGCCGCAGCTTCAGCAGCACGTG CCCGTGCTGAAGGACAGCAGCCTGCTGTTCGA GGAATTCAAGAAGCTGATTAGGAACAGGCAA AGCGAGGCCGCCGACTCCAGCCCGAGCGAGC TGAAGTACCTGGGCCTCGACACCCATAGCCGC AAGAAGCGGCAGCTGTACTCGGCCCTGGCGA ACAAGTGCTGCCACGTGGGCTGCACCAAGCG CAGCCTGGCGCGCTTCTGC | 5' UTR 1 | 3' UTR 4 | 179 |
| Construct 18 | ATGCCCAGGCTGTTTTTCTTCCACCTGCTGGG GGTCTGCCTGCTGCTGAACCAGTTTAGCAGGG CCGTGGCCGACAGCTGGATGGAGGAGGTGAT CAAGCTGTGCGCAGGGAGCTGGTGCGGGCC CAGATCGCCATCTGCGGCATGAGCACCTGGAG CAAGCGGTCCCTGAGCCAGGAGGACGCCCCC CAGACTCCCCGGCCGGTGGCCGAAATCGTGCC CAGCTTCATCAACAAGGACACCGAGACCATC AATATGATGTCCGAGTTCGTGGCCAACCTGCC CCAGGAGCTGAAACTGACCCTGAGCGAGATG CAGCCCGCCCTGCCCCAGCTGCAGCAGCATGT CCCCGTGCTGAAGGACAGCAGCCTGTTGTTTG AGGAGTTCAAAAAACTGATCCGAAACAGGCA GTCGGAGGCCGCTGACAGCTCGCCAAGCGAG CTGAAGTATCTGGGGCTGGACACCCACAGCCG CAAGAAGAGGCAGCTGTATAGCGCGCTGGCC AACAAGTGTGCCACGTGGGCTGCACGAAGA GGTCCCTGGCCAGGTTCTGC | 5' UTR 1 | 3' UTR 4 | 180 |
| Construct 19 | ATGCCCAGGCTGTTCTTCTTCCACCTGCTGGG CGTGTGCCTGCTGCTGAACCAGTTCAGCAGGG CCGTGGCCGACAGCTGGATGGAGGAGGTGAT | 5' UTR 1 | 3' UTR 4 | 181 |

TABLE 6-continued

DNA Sequences

| Name | ORF Sequence | 5' UTR | 3' UTR | SEQ ID NO: |
|------|--------------|--------|--------|------------|
| | CAAGCTGTGCGGCCGGGAGCTCGTGAGGGCC
CAGATCGCGATCTGCGGCATGAGCACCTGGA
GCAAAAGGAGTCTGAGCCAGGAGGACGCGCC
GCAGACGCCCAGGCCCGTCGCCGAGATCGTG
CCGTCCTTCATCAACAAGGACACCGAGACCAT
CAATATGATGAGCGAGTTCGTGGCCAACCTGC
CCCAGGAGCTCAAGCTGACCCTGAGCGAGAT
GCAGCCCGCGCTGCCCCAGCTGCAGCAGCAC
GTGCCCGTGCTGAAGGACTCCAGCCTGCTGTT
CGAGGAGTTCAAGAAACTGATCAGAAACAGG
CAGAGCGAGGCCGCCGACTCCAGCCCCTCAG
AGCTGAAGTACCTGGGCCTGGACACCCACAG
CAGGAAGAAGCGCCAGCTCTACAGCGCCCTG
GCCAACAAGTGCTGCCACGTCGGGTGCACAA
AGAGGAGCCTGGCCAGGTTCTGC | | | |
| Construct 20 | ATGCCCCGGCTGTTCTTCTTCCACCTGCTGGGC
GTGTGCCTCCTGCTGAACCAGTTCAGCAGGGC
CGTGGCCGACAGCTGGATGGAGGAGGTGATC
AAGCTGTGCGGCAGGGAGCTGGTGAGGGCGC
AGATCGCCATCTGCGGCATGAGCACCTGGAGC
AAGAGGAGCCTGAGCCAGGAGGACGCCCCGC
AAACCCCCCGGCCGGTCGCGGAGATAGTGCC
CAGCTTCATAAACAAGGACACCGAGACCATC
AATATGATGAGCGAGTTCGTGGCCAACCTGCC
CCAGGAGCTGAAGCTGACGCTGAGCGAGATG
CAGCCGGCCCTGCCGCAGCTGCAGCAGCACGT
GCCCGTGCTGAAGGACAGCAGCCTCCTGTTCG
AGGAGTTCAAGAAGCTGATCAGGAACCGGCA
GAGCGAGGCCGCCGACTCCAGCCCCAGCGAG
CTGAAGTACCTGGGCCTGGACACCCATAGCAG
GAAGAAGCGCCAGCTGTACAGCGCCCTGGCT
AACAAGTGCTGCCACGTGGGCTGCACCAAGA
GGAGCCTGGCCCGGTTCTGC | 5' UTR 1 | 3' UTR 4 | 182 |
| Construct 21 | ATGCCCCGGCTGTTCTTCTTCCACCTGCTCGGC
GTGTGCCTGCTGCTGAACCAATTCAGCCGGGC
CGTCGCCGACAGCTGGATGGAGGAGGTGATC
AAGCTGTGCGGCAGGGAGCTGGTCAGGGCCC
AGATCGCCATCTGTGGGATGTCGACCTGGTCC
AAGCGCAGCCTGAGCCAGGAGGACGCCCCGC
AGACCCCAAGACCCGTGGCCGAGATCGTGCC
CAGCTTCATCAACAAAGATACCGAGACCATCA
ACATGATGAGCGAGTTCGTGGCCAACCTCCCC
CAGGAGCTGAAGCTGACCCTCAGCGAGATGC
AGCCCGCGCTGCCCCAGCTGCAGCAGCACGTG
CCCGTGCTGAAGGACAGCTCCCTGCTGTTCGA
GGAGTTCAAGAAGCTGATCCGGAACAGGCAG
TCCGAGGCCGCCGACAGCAGCCCGAGCGAGC
TGAAGTACCTGGGGCTGGACACCCACAGCAG
GAAGAAGCGGCAGCTGTACAGCGCCCTGGCC
AACAAGTGCTGCCACGTGGGCTGTACCAAAC
GCAGCCTCGCCAGGTTCTGC | 5' UTR 1 | 3' UTR 4 | 183 |
| Construct 22 | ATGCCCAGGCTGTTCTTCTTCCACCTGCTGGG
GGTCTGTCTCCTGCTGAACCAGTTCAGCCGGG
CCGTGGCCGACTCCTGGATGGAGGAGGTGATC
AAGCTGTGCGGGCGGGAGCTGGTGCGGGCGC
AGATCGCCATCTGCGGCATGTCAACCTGGTCC
AAAAGGTCCCTCAGCCAGGAAGACGCCCCCC
AGACCCCCAGGCCCGTGGCCGAAATCGTGCCC
AGCTTTATCAACAAGGACACCGAGACCATCA
ACATGATGAGCGAGTTTGTGGCCAACCTCCCC
CAGGAGCTGAAGCTGACCCTGAGCGAGATGC
AGCCCGCGCTGCCCCAACTGCAGCAGCACGTG
CCCGTGCTGAAGGACTCGAGCCTGCTGTTCGA
GGAGTTCAAGAAGCTCATCAGGAACAGGCAG
AGCGAGGCCGCCGATTCGAGCCCCAGCGAGC
TCAAGTACCTGGGGCTGGACACTCACAGCCGG
AAGAAGCGGCAGCTGTACAGCGCCCTGGCGA
ACAAGTGTTGCCACGTGGGCTGCACCAAGAG
GAGCCTGGCCAGGTTCTGT | 5' UTR 1 | 3' UTR 4 | 184 |

TABLE 6-continued

DNA Sequences

| Name | ORF Sequence | 5' UTR | 3' UTR | SEQ ID NO: |
|---|---|---|---|---|
| Construct 23 | ATGCCCAGGCTGTTCTTTTTCCACCTCCTGGGG<br>GTGTGTCTGCTCCTGAACCAGTTCAGCAGGGC<br>CGTGGCCGATTCCTGGATGGAGGAGGTCATCA<br>AGCTGTGTGGAAGGGAGCTGGTGAGGGCCCA<br>GATCGCCATCTGCGGGATGTCCACCTGGAGCA<br>AGCGGAGCCTGTCCCAGGAGGACGCCCCGCA<br>GACCCCCAGGCCGGTGGCGGAGATCGTCCCC<br>AGCTTCATCAACAAGGACACCGAGACCATCA<br>ACATGATGAGCGAGTTCGTGGCCAACCTGCCC<br>CAGGAACTGAAGCTCACCCTGAGTGAGATGC<br>AGCCCGCCCTGCCCCAGCTGCAGCAGCATGTG<br>CCCGTGCTGAAGGACAGCAGCCTGCTCTTCGA<br>GGAGTTCAAGAAGCTGATCAGGAACAGGCAG<br>AGCGAGGCCGCCGACAGCTCCCCCTCCGAGCT<br>GAAGTACCTTGGACTGGACACCCACAGCCGG<br>AAGAAGCGGCAACTGTACTCCGCCCTGGCCA<br>ACAAGTGCTGCCACGTGGGCTGTACGAAGAG<br>GAGCCTGGCCAGGTTCTGC | 5' UTR 1 | 3' UTR 4 | 185 |
| Construct 24 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTGATC<br>AAGCTGTGCGGCCGGGAGCTGGTGCGGGCCC<br>AGATCGCCATCTGCGGCATGAGCACCTGGAGC<br>AAGCGGAGCCTGAGCCAGGAGGACGCCCCCC<br>AGACCCCCCGGCCCGTGGCCGAGATCGTGCCC<br>AGCTTCATCAACAAGGACACCGAGACCATCA<br>ACATGATGAGCGAGTTCGTGGCCAACCTGCCC<br>CAGGAGCTGAAGCTGACCCTGAGCGAGATGC<br>AGCCCGCCCTGCCCCAGCTGCAGCAGCACGTG<br>CCCGTGCTGAAGGACAGCAGCCTGCTGTTCGA<br>GGAGTTCAAGAAGCTGATCCGGAACCGGCAG<br>AGCGAGGCCGCCGACAGCAGCCCCAGCGAGC<br>TGAAGTACCTGGGCCTGGACACCCACAGCCG<br>GAAGAAGCGGCAGCTGTACAGCGCCCTGGCC<br>AACAAGTGCTGCCACGTGGGCTGCACCAAGC<br>GGAGCCTGGCCCGGTTCTGC | 5' UTR 1 | 3' UTR 4 | 186 |
| Construct 25 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTGATC<br>AAGCTGTGCGGGAGGGAGCTGGTGAGGGCGC<br>AGATCGCGATCTGCGGGATGAGCACGTGGAG<br>CAAGAGGAGCCTGAGCCAGGAGGACGCGCCG<br>CAGACGCCGAGGCCGGTGGCGGAGATCGTGC<br>CGAGCTTCATCAACAAGGACACGGAGACGAT<br>CAACATGATGAGCGAGTTCGTGGCGAACCTGC<br>CGCAGGAGCTGAAGCTGACGCTGAGCGAGAT<br>GCAGCCGGCGCTGCCGCAGCTGCAGCAGCAC<br>GTGCCGGTGCTGAAGGACAGCAGCCTGCTGTT<br>CGAGGAGTTCAAGAAGCTGATCAGGAACAGG<br>CAGAGCGAGGCGGCGGACAGCAGCCCGAGCG<br>AGCTGAAGTACCTGGGGCTGGACACGCACAG<br>CAGGAAGAAGAGGCAGCTGTACAGCGCGCTG<br>GCGAACAAGTGCTGCCACGTGGGGTGCACGA<br>AGAGGAGCCTGGCGAGGTTCTGC | 5' UTR 4 | 3' UTR 4 | 187 |
| Construct 26 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTCATC<br>AAGCTCTGCGGCCGCGAGCTCGTCCGCGCCCA<br>GATCGCCATCTGCGGCATGTCCACCTGGTCCA<br>AGCGCTCCCTCTCCCAGGAGGACGCCCCCCAG<br>ACCCCCCGCCCCGTCGCCGAGATCGTCCCCTC<br>CTTCATCAACAAGGACACCGAGACCATCAAC<br>ATGATGTCCGAGTTCGTCGCCAACCTCCCCCA<br>GGAGCTCAAGCTCACCCTCTCCGAGATGCAGC<br>CCGCCCTCCCCAGCTCCAGCAGCACGTCCCC<br>GTCCTCAAGGACTCCTCCCTCCTCTTCGAGGA<br>GTTCAAGAAGCTCATCCGCAACCGCCAGTCCG<br>AGGCCGCCGACTCCTCCCCCTCCGAGCTCAAG<br>TACCTCGGCCTCGACACCCACTCCCGCAAGAA<br>GCGCCAGCTCTACTCCGCCCTCGCCAACAAGT | 5' UTR 1 | 3' UTR 4 | 188 |

TABLE 6-continued

DNA Sequences

| Name | ORF Sequence | 5' UTR | 3' UTR | SEQ ID NO: |
|---|---|---|---|---|
| | GCTGCCACGTCGGCTGCACCAAGCGCTCCCTC GCCCGCTTCTGC | | | |
| Construct 27 | ATGCCCCGGCTGTTCTTTTTCCACCTGCTGGGC GTGTGCCTGCTGCTGAACCAGTTTTCTAGGGC CGTGGCCGACAGCTGGATGGAGGAAGTGATC AAGCTGTGCGGCCGGGAGCTGGTGAGAGCAC AGATCGCCATCTGTGGCATGTCCACCTGGAGC GGCTCCAACGGCTCTACCAACGATTCTAATGG CAGCACAGGCTCCCAGCTGTACAGCGCCCTGG CCAATAAGTGCTGTCACGTGGGCTGCACAAAG AGGTCCCTGGCCCGCTTCTGT | 5' UTR 1 | 3' UTR 2 | 189 |
| Construct 28 | ATGCCCCGGCTGTTCTTTTTCCACCTGCTGGGC GTGTGCCTGCTGCTGAACCAGTTTTCTAGGGC CGTGGCCGACAGCTGGATGGAGGAAGTGATC AAGCTGTGCGGCCGGGAGCTGGTGAGAGCAC AGATCGCCATCTGTGGCATGTCCACCTGGAGC GGCTCCAACGGCTCTACCAACACCTCTAATGG CGACACAGGCTCCCAGCTGTACAGCGCCCTGG CCAATAAGTGCTGTCACGTGGGCTGCACAAAG AGGTCCCTGGCCCGCTTCTGT | 5' UTR 1 | 3' UTR 2 | 190 |
| Construct 29 | ATGCCCCGGCTGTTCTTTTTCCACCTGCTGGGC GTGTGCCTGCTGCTGAACCAGTTTTCTAGGGC CGTGGCCGACAGCTGGATGGAGGAAGTGATC AAGCTGTGCGGCCGGGAGCTGGTGAGAGCAC AGATCGCCATCTGTGGCATGTCCACCTGGAGC GGCTCCAACGGCAAGACCAACACCTCTAATG GCGACACAGGCTCCCAGCTGTACAGCGCCCTG GCCAATAAGTGCTGTCACGTGGGCTGCACAAA GAGGTCCCTGGCCCGCTTCTGT | 5' UTR 1 | 3' UTR 2 | 191 |
| Construct 30 | ATGCCCCGGCTGTTCTTTTTCCACCTGCTGGGC GTGTGCCTGCTGCTGAACCAGTTTTCCAGGGC CGTGGCCGACTCTTGGATGGAGGAAGTGATCA AGCTGTGCGGCCGGGAGCTGGTGAGAGCACA GATCGCCATCTGTGGCATGTCTACCTGGTCTG GCAGCACAAACTCCGGCTCTACCAGCTCCGGC AACAGCGGCTCCGGCAATTCTGGCAGCCAGCT GTACAGCGCCCTGGCCAATAAGTGCTGTCACG TGGGCTGCACAAAGAGGTCCCTGGCCCGCTTC TGT | 5' UTR 1 | 3' UTR 2 | 192 |
| Construct 31 | ATGCCCCGGCTGTTCTTTTTCCACCTGCTGGGC GTGTGCCTGCTGCTGAACCAGTTTTCCAGGGC CGTGGCCGACTCTTGGATGGAGGAAGTGATCA AGCTGTGCGGCCGGGAGCTGGTGAGAGCACA GATCGCCATCTGTGGCATGAGCACCTGGTCTG GCAGCACAAACTCCGGCTCTGATACCAGCTCC GGCAACAGCGGCTCCGGCAATTCTGGCCAGCT GTACAGCGCCCTGGCCAATAAGTGCTGTCACG TGGGCTGCACAAAGAGGTCCCTGGCCCGCTTC TGT | 5' UTR 1 | 3' UTR 2 | 193 |
| Construct 32 | ATGCCCCGGCTGTTCTTTTTCCACCTGCTGGGC GTGTGCCTGCTGCTGAACCAGTTTTCTAGGGC CGTGGCCGACAGCTGGATGGAGGAAGTGATC AAGCTGTGCGGCCGGGAGCTGGTGAGAGCAC AGATCGCCATCTGTGGCATGTCCACCTGGAGC GGCTCCACAAACTCTGGCAGCGATACCGGCTC TGGCAACTCCAAGTCTGGCAATAGCGGCCAGC TGTACTCCGCCCTGGCCAATAAGTGCTGTCAC GTGGGCTGCACAAAGAGGAGCCTGGCCCGCT TCTGT | 5' UTR 1 | 3' UTR 2 | 194 |
| Construct 33 | ATGCCCCGGCTGTTCTTTTTCCACCTGCTGGGC GTGTGCCTGCTGCTGAACCAGTTTTCTAGGGC CGTGGCCGACAGCTGGATGGAGGAAGTGATC AAGCTGTGCGGCCGGGAGCTGGTGAGAGCAC AGATCGCCATCTGTGGCATGTCCACCTGGAGC GGCTCCACAAACTCTGGCAGCGACACCTCCGG CAAGAACTCTGGCGATGGCAATAGCGGCCAG CTGTACTCCGCCCTGGCCAATAAGTGCTGTCA | 5' UTR 1 | 3' UTR 2 | 195 |

TABLE 6-continued

DNA Sequences

| Name | ORF Sequence | 5' UTR | 3' UTR | SEQ ID NO: |
|---|---|---|---|---|
| | CGTGGGATGCACAAAGCGGAGCCTGGCCCGC<br>TTCTGT | | | |
| Construct 34 | ATGCCCCGGCTGTTCTTTTTCCACCTGCTGGGC<br>GTGTGCCTGCTGCTGAACCAGTTTAGCAGGGC<br>CGTGGCAGACTCCTGGATGGAGGAAGTGATC<br>AAGCTGTGCGGCCGGGAGCTGGTGAGAGCAC<br>AGATCGCCATCTGTGGCATGTCTACCTGGTCT<br>GGCAGCACAGACTCCGGCTCTGATACCAGCTC<br>CGGCAACAGCGGCGATGGCAATTCCGGCCAG<br>CTGTACTCTGCCCTGGCCAATAAGTGCTGTCA<br>CGTGGGCTGCACAAAGAGGAGCCTGGCCCGC<br>TTCTGT | 5' UTR 1 | 3' UTR 2 | 196 |
| Construct 35 | ATGCCCCGGCTGTTCTTTTTCCACCTGCTGGGC<br>GTGTGCCTGCTGCTGAACCAGTTTTCCAGGGC<br>CGTGGCCGACTCTTGGATGGAGGAAGTGATCA<br>AGCTGTGCGGCCGGGAGCTGGTGAGAGCACA<br>GATCGCCATCTGTGGCATGTCTACCTGGAGCG<br>GCAGCTCCGGCTCTACAAACGATTCCAATGGC<br>TCTACCGGCACAGGCAGCGACGGCTCCACCA<br>ACGGCTCTGATGGCAGCACAGGAGGACAGCT<br>GTACAGCGCCCTGGCCAATAAGTGCTGTCACG<br>TGGGATGCACCAAGAGGTCCCTGGCCCGCTTC<br>TGT | 5' UTR 1 | 3' UTR 2 | 197 |
| Construct 36 | ATGCCCCGGCTGTTCTTTTTCCACCTGCTGGGC<br>GTGTGCCTGCTGCTGAACCAGTTTAGCAGGGC<br>CGTGGCAGACTCCTGGATGGAGGAAGTGATC<br>AAGCTGTGCGGCCGGGAGCTGGTGAGAGCAC<br>AGATCGCCATCTGTGGCATGAGCACCTGGTCC<br>GGCTCTACAAACAGCGGCTCCGACACCAGCTC<br>CGGCTCCACAAATTCTGGCAGCGATACCTCTA<br>GCGGCAACTCCGGCTCTGGCAATAGCGGCTCC<br>AAGGGCACCGGCTCTGATGGCAGCACAAACG<br>GCTCCAATGGCTCTACCGGAGGACAGCTGTAC<br>TCTGCCCTGGCCAATAAGTGCTGTCACGTGGG<br>CTGCACAAAGAGGTCCCTGGCCCGCTTCTGT | 5' UTR 1 | 3' UTR 2 | 198 |
| Construct 37 | ATGCCCAGGCTGTTCTTTTTCCACCTGCTGGGC<br>GTGTGCCTGCTGCTGAACCAGTTTTCCCGCGC<br>CGTGGCAGACTCTTGGATGGAGGAAGTGATC<br>AAGCTGTGCGGCCGGGAGCTGGTGAGAGCAC<br>AGATCGCCATCTGTGGCATGTCTACCTGGAGC<br>AAGCGGTCCCTGTCTCAGGAGGACGCCCCTCA<br>GACACCTAGACCAGTGGCCGAGATCGTGCCC<br>AGCTTCATCAACAAGGATACCGAGACAATCA<br>ATATGATGTCCGAGTTCGTGGCCAATCTGCCT<br>CAGGGAGCTGAAGCTGACCCTGTCCGAGATGC<br>AGCCAGCCCTGCCACAGCTGCAGCAGCACGT<br>GCCAGTGCTGAAGGATAGCTCCCTGCTGTTTG<br>AGGAGTTCAAGAAGCTGATCCGGAACAGACA<br>GTCCGAGGCCGCCGACTCTAGCCCTTCTGAGC<br>TGAAGTACCTGGGCCTGGATACCCACAGCAG<br>GAAGAAGCGCCAGCTGTATTCCGCCCTGGCCA<br>ATAAGTGCTGTCACGTGGGCTGCACAAAGAG<br>GTCCCTGGCCCGCTTTTGTGGCGGCGGCGGCT<br>CTGGAGGAGGAGGCAGCGGCGGAGGAGGCAG<br>CATGGTGCGGTCCGTGGAGTGCCCACCTTGTC<br>CAGCACCACCAGTGGCAGGCCCTAGCGTGTTT<br>CTGTTCCCTCCAAAGCCAAAGGACACCCTGAT<br>GATCTCTAGGACCCCCGAGGTGACATGCGTGG<br>TGGTGGACGTGAGCCACGAGGACCCCGAGGT<br>GCAGTTCAACTGGTACGTGGATGGCATGGAG<br>GTGCACAATGCCAAGACAAAGCCCCGGGAGG<br>AGCAGTTTAACAGCACCTTCAGAGTGGTGTCC<br>GTGCTGACAGTGGTGCACCAGGACTGGCTGA<br>ACGGCAAGGAGTATAAGTGCGCCGTGTCCAA<br>TAAGGGCCTGCCAGCACCTATCGAGAAGACC<br>ATCTCTAAGACAAAGGGCCAGCCTAGGGAGC<br>CACAGGTGTACACCCTGCCCCCTTCCCGCGAG<br>GAGATGACCAAGAACCAGGTGTCTCTGACAT<br>GTCTGGTGAAGGGCTTTTATCCCTCTGACATC<br>GCCGTGGAGTGGGAGAGCAATGGCCAGCCTG | 5' UTR 1 | 3' UTR 2 | 199 |

TABLE 6-continued

DNA Sequences

| Name | ORF Sequence | 5' UTR | 3' UTR | SEQ ID NO: |
|---|---|---|---|---|
| | AGAACAATTACAAGACCACACCACCCATGCT GGACTCCGATGGCAGCTTCTTCCTGTATTCTA AGCTGACAGTGGATAAGAGCCGGTGGCAGCA GGGCAACGTGTTCAGCTGTTCCGTGATGCACG AGGCCCTGCACAATCACTACACCCAGAAGTCT CTGAGCCTGTCCCCCGGCAAGGGCAAGCCAAT CCCCAATCCTCTGCTGGGCCTGGATAGCACAC ACCACCACCACCACCAC | | | |
| Construct 38 | ATGCCTAGGCTGTTCTTTTTCCACCTGCTGGGC GTGTGCCTGCTGCTGAACCAGTTTTCTCGCGC CGTGGCAGACAGCTGGATGGAGGAAGTGATC AAGCTGTGCGGCCGGGAGCTGGTGCGCGCAC AGATCGCCATCTGTGGCATGAGCACCTGGTCC AAGCGGAGCCTGAGCCAGGAGGACGCACCAC AGACACCCAGACCTGTGGCCGAGATCGTGCCT TCCTTTATCAACAAGGATACCGAGACAATCAA TATGATGTCTGAGTTCGTGGCCAATCTGCCCC AGGAGCTGAAGCTGACCCTGTCCGAGATGCA GCCAGCCCTGCCACAGCTGCAGCAGCACGTGC CTGTGCTGAAGGATAGCTCCCTGCTGTTTGAG GAGTTCAAGAAGCTGATCCGGAACAGACAGT CCGAGGCCGCCGACTCTAGCCCATCTGAGCTG AAGTACCTGGGCCTGGATACCCACAGCAGGA AGAAGCGCCAGCTGTATTCCGCCCTGGCCAAT AAGTGCTGTCACGTGGGCTGCACAAAGCGGTC CCTGGCCAGATTTTGTGGCGGCGGCGGCTCTG GAGGAGGAGGCAGCGGCGGAGGAGGCTCCGA CATCCAGATGACCCAGAGCCCTTCCTCTCTGT CCGCCTCTGTGGGCGATCGGGTGACCATCACA TGCAGGGCCAGCCGGCCCATCGGCACAATGCT GAGCTGGTATCAGCAGAAGCCTGGCAAGGCC CCAAAGCTGCTGATCCTGGCCTTCTCTAGGCT GCAGAGCGGCGTGCCCTCCCGCTTTAGCGGCT CCGGCTCTGGCACCGACTTCACCCTGACAATC AGCTCCCTGCAGCCAGAGGATTTTGCCACCTA CTATTGTGCCCAGGCCGGCACACACCCCACCA CATTCGGCCAGGGCACCAAGGTGGAGATCAA GAGGGGCAAGCCAATCCCCAACCCTCTGCTGG GCCTGGACAGCACACACCACCACCACCACCA C | 5' UTR 1 | 3' UTR 2 | 200 |
| Construct 39 | ATGCCTCGACTGTTCTTTTTCCACCTGCTGGGC GTGTGCCTGCTGCTGAATCAGTTTAGCCGGGC CGTCGCCGATAGTTGGATGGAGGAAGTGATC AAGCTGTGCGGCCGGGAGCTGGTGAGAGCAC AGATCGCCATCTGTGGCATGTCCACCTGGTCT GGCAGCTCCGGAGGAGGCTCTGGCTCTAGCTC CGGCTCTAGCGGCAGCGGCGGCTCCGGCCAG CTGTACAGCGCTCTGGCTAATAAGTGTTGTCA CGTCGGATGTACTAAACGAAGTCTGGCTAGAT TTTGC | 5' UTR 1 | 3' UTR 2 | 201 |
| Construct 40 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGAAATTGTGCCATCC TTCATCAACAAAGATACAGAAACCATAAATAT GATGTCAGAATTTGTTGCTAATTTGCCACAGG AGCTGAAGTTAACCCTGTCTGAGATGCAGCCA GCATTACCACAGCTACAACAACATGTACCTGT ATTAAAAGATTCCAGTCTTCTCTTTGAAGAAT TTAAGAAACTTATTCGCAATAGACAAAGTGAA GCCGCAGACAGCAGTCCTTCAGAATTAAAATA CTTAGGCTTGGATACTCATTCTCGAAAAAAGA GACAACTCTACAGTGCATTGGCTAATAAATGT TGCCATGTTGGTTGTACCAAAAGATCTCTTGC TAGATTTTGC | 5' UTR 1 | 3' UTR 2 | 202 |
| Construct 41 | ATGGGCGTGAAAGTGCTGTTTGCGCTGATTTG CATTGCGGTGGCGGAAGCGGACTCATGGATG | 5' UTR 1 | 3' UTR 2 | 203 |

TABLE 6-continued

DNA Sequences

| Name | ORF Sequence | 5' UTR | 3' UTR | SEQ ID NO: |
|------|--------------|--------|--------|------------|
| | GAGGAAGTTATTAAATTATGCGGCCGCGAATT<br>AGTTCGCGCGCAGATTGCCATTTGCGGCATGA<br>GCACCTGGAGCAAAAGGTCTCTGAGCCAGGA<br>AGATGCTCCTCAGACACCTAGACCAGTGGCAG<br>AAATTGTGCCATCCTTCATCAACAAAGATACA<br>GAAACCATAAATATGATGTCAGAATTTGTTGC<br>TAATTTGCCACAGGAGCTGAAGTTAACCCTGT<br>CTGAGATGCAGCCAGCATTACCACAGCTACAA<br>CAACATGTACCTGTATTAAAAGATTCCAGTCT<br>TCTCTTTGAAGAATTTAAGAAACTTATTCGCA<br>ATAGACAAAGTGAAGCCGCAGACAGCAGTCC<br>TTCAGAATTAAAATACTTAGGCTTGGATACTC<br>ATTCTCGAAAAAAGAGACAACTCTACAGTGC<br>ATTGGCTAATAAATGTTGCCATGTTGGTTGTA<br>CCAAAAGATCTCTTGCTAGATTTTGC | | | |
| Construct 42 | ATGGGCGTGAAAGTGCTGTTTGCGCTGATTTG<br>CATTGCGGTGGCGGAAGCGGACTCATGGATG<br>GAGGAAGTTATTAAATTATGCGGCCGCGAATT<br>AGTTCGCGCGCAGATTGCCATTTGCGGCATGG<br>AGCCCAAGAGCAGCGACAAGACCCACACCAG<br>CCCCCCCAGCCCCGCCCCCGAGCTGCTGGGCG<br>GCAGCAGCGTGTTCCTGTTCCCCCCCAAGCCC<br>AAGGACACCCTCTACATCACCAGGGAGCCCG<br>AGGTGACCTGCGTGGTGGTGGACGTGAGCCA<br>CGAGGACCCCGAGGTGAAGTTCAACTGGTAC<br>GTGGACGGCGTGGAGGTGCACAACGCCAAGA<br>CCAAGCCCAGGGAGGAGCAGTACAACAGCAC<br>CTACAGGGTGGTGAGCGTGCTGACCGTGCTGC<br>ACCAGGACTGGCTGAACGGCAAGGAGTACAA<br>GTGCAAGGTGAGCAACAAGGCCCTGCCCGCC<br>CCCATCGAGAAGACCATCAGCAAGGCCAAGG<br>GCCAGCCCAGGGAGCCCCAGGTGTACACCCT<br>GCCCCCCAGCAGGGACGAGCTGACCAAGAAC<br>CAGGTGAGCCTGACCTGCCTGGTGAAGGGCTT<br>CTACCCCAGCGACATCGCCGTGGAGTGGGAG<br>AGCAACGGCCAGCCCGAGAACAACTACAAGA<br>CAACCCCCCCCGTGCTGGACAGCGACGGCAG<br>CTTCTTCCTGTACAGCAAGCTGACCGTGGACA<br>AGAGCAGGTGGCAGCAGGGCAACGTGTTCAG<br>CTGCAGCGTGATGCACGAGGCCCTGCACAACC<br>ACTACACCCAGAAGAGCCTGAGCCTGAGCCC<br>CGGCAAGAGGAAGAGCACCTGGAGCAAAAGG<br>TCTCTGAGCCAGGAAGATGCTCCTCAGACACC<br>TAGACCAGTGGCAGAAATTGTGCCATCCTTCA<br>TCAACAAAGATACAGAAACCATAAATATGAT<br>GTCAGAATTTGTTGCTAATTTGCCACAGGAGC<br>TGAAGTTAACCCTGTCTGAGATGCAGCCAGCA<br>TTACCACAGCTACAACAACATGTACCTGTATT<br>AAAAGATTCCAGTCTTCTCTTTGAAGAATTTA<br>AGAAACTTATTCGCAATAGACAAAGTGAAGC<br>CGCAGACAGCAGTCCTTCAGAATTAAAATACT<br>TAGGCTTGGATACTCATTCTCGAAAAAAGAGA<br>CAACTCTACAGTGCATTGGCTAATAAATGTTG<br>CCATGTTGGTTGTACCAAAAGATCTCTTGCTA<br>GATTTTGC | 5' UTR 1 | 3' UTR 2 | 204 |
| Construct 43 | ATGGGCGTGAAAGTGCTGTTTGCGCTGATTTG<br>CATTGCGGTGGCGGAAGCGGACTCATGGATG<br>GAAGAGGTTATTAAATTATGTGGCCGTGAATT<br>GGTGCGTGCACAAATAGCTATTTGCGGCATGG<br>GCGGTGGCGGCTCTGGTGGCGGCGGCTCTGGA<br>GGGGGCGGAAGTGGTGGAGGAGGTAGTGGCG<br>GAGGTGGATCGGGAGGCGGAGGATCTGGAGG<br>GGGGGGCTCCTTTCAAAGCTCCTCGAGCAAAG<br>CGCCCCCTCCCAGCCTGCCCAGCCCTAGTAGG<br>CTGCCCGGTCCGAGCGACACGCCCATCCTGCC<br>CCAGGGTGGCGGTGGCTCTGGGGGTGGCGGTT<br>CAGGCGGAGGTGGTTCTGGCGGAGGCGGATC<br>AGGTGGTGGGGGATCCGGCGGCGGCGGATCT<br>GGTGGCGGGGGGAGTCAGCTCTACTCTGCGTT<br>GGCCAATAAATGCTGCCATGTTGGTTGTACAA<br>AAAGATCTTTGGCTAGATTTTGC | 5' UTR 1 | 3' UTR 2 | 205 |

TABLE 6-continued

DNA Sequences

| Name | ORF Sequence | 5' UTR | 3' UTR | SEQ ID NO: |
|---|---|---|---|---|
| Construct 44 | ATGGGCGTGAAGGTGCTGTTCGCACTGATCTG CATCGCCGTGGCCGAGGCCGACAGCTGGATG GAGGAGGTGATCAAGCTGTGCGGCAGAGAGC TGGTGAGAGCCCAGATCGCCATCTGCGGCATG AGCACCTGGAGCGAGCCCAAGAGCAGCGACA AGACCCACACCAGCCCCCCCAGCCCCGCTCCC GAGCTGCTGGGCGGCAGCAGCGTGTTCCTGTT CCCCCCCAAGCCCAAGGACACCCTGTACATAA CCAGAGAGCCAGAGGTGACCTGCGTGGTGGT GGACGTGAGCCACGAGGACCCCGAGGTGAAG TTCAACTGGTACGTGGACGGCGTGGAGGTGCA CAACGCCAAGACAAAGCCCAGAGAGGAGCAG TACAACAGCACCTACAGAGTGGTGAGCGTGCT GACCGTGCTGCACCAGGACTGGCTGAACGGC AAGGAGTATAAGTGCAAGGTGAGCAACAAGG CCCTGCCCGCCCCCATCGAGAAGACCATCAGC AAGGCCAAGGGCCAGCCCAGAGAGCCCCAGG TGTACACCCTGCCCCCCAGCAGAGACGAGCTG ACCAAGAACCAGGTGAGCCTGACCTGCCTGGT GAAGGGCTTCTACCCCAGCGACATCGCCGTGG AGTGGGAGAGCAACGGCCAGCCCGAGAACAA CTACAAGACCACCCCCCCCGTGCTGGACAGCG ACGGCAGCTTCTTCCTGTACAGCAAGCTGACC GTGGACAAGAGCAGATGGCAGCAGGGCAACG TGTTCAGCTGCAGCGTGATGCACGAGGCCTTA CACAACCACTACACCCAGAAGAGCCTAAGCC TGAGCCCCGGCAAGAGAAAGAAGGAGAAGTCT GAGCCAGGAGGACGCCCCCAGACCCCCAGA CCCGTGGCCGAGATCGTGCCCTCCTTCATTAA CAAGGACACCGAGACCATCAACATGATGAGC GAGTTCGTGGCCAACCTGCCCCCAGGAGCTGAA GCTGACCCTGAGCGAAATGCAACCCGCCCTGC CCCAGCTGCAACAGCACGTGCCCGTGCTGAAG GACAGCAGCCTGCTGTTCGAGGAGTTCAAAA AGCTGATCAGAAACAGACAGAGCGAGGCCGC CGACTCCAGCCCCAGCGAGCTGAAGTACCTGG GCCTGGACACCCACAGCAGAAAGAAGAGACA GCTGTACAGCGCCCTGGCCAACAAGTGCTGCC ACGTGGGCTGCACCAAGAGAAGCCTGGCCAG ATTCTGC | 5' UTR 1 | 3' UTR 1 | 206 |
| Construct 45 | ATGGGAGTTAAAGTGCTTTTTGCGCTTATTTGT ATTGCGGTCGCGGAGGCTGACTCATGGATGGA AGAGGTCATTAAGCTCTGTGGAAGGGAACTC GTTAGAGCCCAAATAGCTATTTGCGGGATGAG TACATGGTCCGGTGGGGGTGGTTCGGGTGGAG GTGGGTCGGAGGAGGAGGCTCCGGTGGAGG CGGCAGTGGGGGCGGAGGGTCCGGTGGGGGT GGGTCTGGAGGAGGTGGTTCGTTTCAGTCTTC ATCTTCCAAAGCTCCTCCTCCTTCGCTTCCCAG CCCTAGCAGGCTTCCAGGTCCATCAGATACTC CAATATTGCCCCAGGGAGGGGTGGATCAGG AGGAGGAGGGAGTGGTGGGGGAGGATCTGGT GGAGGTGGTTCCGGAGGAGGAGGAAGCGGGG GGGGAGGTTCAGGCGGTGGTGGAAGCCAACT GTATAGTGCGTTGGCTAACAAATGTTGTCATG TCGGATGTACTAAAAGGAGCCTCGCCAGGTTT TGC | 5' UTR 1 | 3' UTR 1 | 207 |
| Construct 46 | ATGGGCGTGAAAGTGCTGTTTGCGCTGATTTG CATTGCGGTGGCGGAAGCGGACTCATGGATG GAGGAAGTTATTAAATTATGCGGCCGCGAATT AGTTCGCGCGCAGATTGCCATTTGCGGCATGA GCACCTGGAGCAAAAGGTCTCTGAGCCAGGA AGATGCTCCTCAGACACCTAGACCAGTGGCAG AAATTGTGCCATCCTTCATCAACAAAGATACA GAAACCATAAATATGATGTCAGAATTTGTTGC TAATTTGCCACAGGAGCTGAAGTTAACCCTGT CTGAGATGCAGCCAGCATTACCACAGCTACAA CAACATGTACCTGTATTAAAAGATTCCAGTCT TCTCTTTGAAGAATTTAAGAAACTTATTCGCA ATAGACAAAGTGAAGCCGCAGACAGCAGTCC TTCAGAATTAAAATACTTAGGCTTGGATACTC ATTCTCGAAAAAAGAGACAACTCTACAGTGC | 5' UTR 1 | 3' UTR 1 | 208 |

TABLE 6-continued

DNA Sequences

| Name | ORF Sequence | 5' UTR | 3' UTR | SEQ ID NO: |
|---|---|---|---|---|
| | ATTGGCTAATAAATGTTGCCATGTTGGTTGTA<br>CCAAAAGATCTCTTGCTAGATTTTGC | | | |
| Construct 47 | ATGAGCAGCAGACTGCTGCTGCAGCTGCTGGG<br>CTTCTGGCTGTTCCTGAGCCAGCCCTGCAGAG<br>CCAGAGTGAGCGAGGAGTGGATGGACCAGGT<br>GATCCAGGTGTGCGGCAGAGGCTACGCCAGA<br>GCCTGGATCGAGGTGTGCGGCCCCAGCGTGG<br>GCAGACTGGCCCTGAGCCAGGAGGAGCCCGC<br>CCCCCTGGCCAGACAGGCCACCGCCGAGGTG<br>GTGCCCAGCTTCATCAACAAGGACGCCGAGCC<br>CTTCGACATGACCCTGAAGTGCCTGCCCAACC<br>TGAGCGAGGAGAGAAAGGCCGCCCTGAGCGA<br>GGGCAGAGCCCCCTTCCCCGAGCTGCAGCAGC<br>ACGCCCCCGCCCTGAGCGACAGCGTGGTGAG<br>ACTGGAGGGCTTCAAGAAGACCTTCCACAACC<br>AGCTGGGCGAGGCCGAGGACGCGGCCCCCC<br>CGAGCTGAAGTACCTGGGCAGCGACGCCCAG<br>AGCAGAAAGAAGAGACAGAGCGGCGCCCTGC<br>TGAGCGAGCAGTGCTGCCACATCGGCTGCACC<br>AGAAGAAGCATCGCCAAGCTGTGC | 5' UTR 1 | 3' UTR 2 | 209 |
| Construct 48 | ATGGGGGTGAAGGTGCTGTTCGCCCTCATCTG<br>CATAGCGGTGGCCGAGGCCGACTCTTGGATGG<br>AGGAGGTGATCAAGCTCTGCGGCAGGGAGCT<br>CGTGCGTGCCCAGATCGCGATCTGCGGCATGA<br>GCACCTGGTCAGAGCCAAAGAGCAGCGATAA<br>GACGCATACCAGCCCTCCCAGCCCCGCCCCCG<br>AGCTGCTGGGCGGGAGCAGCGTGTTCCTCTTC<br>CCACCCAAGCCAAAGGACACCCTCTACATCAC<br>CCGCGAGCCCGAGGTGACGTGCGTTGTGGTGG<br>ACGTGTCCCACGAGGACCCCGAGGTCAAGTTC<br>AACTGGTACGTGGACGGCGTGGAAGTCCACA<br>ACGCCAAGACCAAGCCTCGGGAGGAGCAGTA<br>CAACAGCACCTACAGGGTGGTGAGCGTCCTG<br>ACAGTCCTGCACCAGGACTGGCTGAATGGCA<br>AGGAATACAAGTGCAAGGTGTCAAACAAGGC<br>CCTGCCCGCCCCCATCGAGAAAACCATCAGCA<br>AGGCCAAGGGCAGCCACGTGAGCCCCAGGT<br>GTACACCCTGCCCCCCAGCAGGGACGAGCTCA<br>CCAAGAACCAGGTGAGCCTGACCTGCCTGGTG<br>AAAGGTTTCTACCCTTCTGACATCGCGGTTGA<br>GTGGGAGAGCAATGGCCAACCCGAGAACAAC<br>TACAAGACAACCCCGCCGTGCTGGACTCCGA<br>TGGGAGCTTCTTCCTGTATAGCAAGCTGACCG<br>TGGACAAGAGCCGCTGGCAGCAGGGCAACGT<br>GTTCAGCTGCTCCGTCATGCACGAGGCCCTGC<br>ATAACCACTACACCCAAAAGAGCCTGTCCCTG<br>AGCCCCGGCAAGCGCAAGAAGAGGTCCCTGA<br>GCCAAGAAGACGCCCCGCAGACGCCCAGGCC<br>CGTGGCCGAGATCGTGCCCAGCTTCATCAACA<br>AGGATACCGAGACAATCAACATGATGTCGGA<br>ATTTGTGGCTAACCTGCCCCAAGAGCTGAAAC<br>TGACCCTGTCGGAAATGCAGCCCGCGCTGCCG<br>CAGCTGCAGCAGCACGTGCCGGTGCTGAAGG<br>ATAGCAGCTTGCTGTTCGAGGAATTCAAGAAG<br>CTCATCCGTAATCGACAGAGCGAGGCGGCCG<br>ATTCCAGCCCCAGCGAGCTGAAGTATCTGGGG<br>CTGGATACCCACAGCCGCAAGAAGCGGCAGC<br>TGTACTCTGCTCTGGCCAATAAGTGTTGCCAC<br>GTCGGCTGCACCAAACGCAGCCTGGCCAGGTT<br>CTGC | 5' UTR 1 | 3' UTR 1 | 210 |
| Construct 49 | ATGGGCGTCAAGGTCCTCTTCGCCCTTATCTG<br>CATCGCCGTGGCCGAGGCCGACAGCTGGATG<br>GAGGAGGTGATCAAGCTTTGCGGCCGGGAGC<br>TTGTGCGCGCGCAGATCGCCATTTGCGGCATG<br>AGCACCTGGTCCGAACCAAAGAGCTCCGACA<br>AGACCCACACCTCCCCTCCTTCCCCCGCCCCC<br>GAGCTGCTGGGCGGCAGCAGCGTCTTCCTGTT<br>CCCGCCCAAGCCCAAGGACACCCTGTACATCA<br>CCAGGGAGCCCGAGGTGACATGTGTCGTGGT<br>GGACGTGTCACACGAGGACCCCGAGGTGAAG<br>TTCAACTGGTACGTCGACGGCGTGGAGGTGCA | 5' UTR 1 | 3' UTR 1 | 211 |

TABLE 6-continued

DNA Sequences

| Name | ORF Sequence | 5' UTR | 3' UTR | SEQ ID NO: |
|------|--------------|--------|--------|------------|
| | CAACGCAAAAACCAAGCCCCGGGAGGAACAG<br>TACAACAGCACCTACCGGGTGGTCAGCGTGCT<br>GACCGTGCTCCATCAGGACTGGCTGAACGGCA<br>AGGAGTACAAATGCAAGGTCAGCAACAAAGC<br>CCTGCCCGCCCCAATCGAAAAGACCATCTCCA<br>AGGCCAAGGGGCAGCCCAGGGAACCCCAGGT<br>GTACACCCTGCCCCCCAGCAGGGACGAGCTCA<br>CCAAGAACCAGGTGAGCCTGACCTGCCTGGTG<br>AAGGGGTTCTACCCCAGCGACATCGCCGTGGA<br>GTGGGAAAGCAACGGCCAACCCGAAAACAAC<br>TACAAGACCACCCCGCCGGTGCTGGACTCTGA<br>CGGCAGCTTCTTCCTCTACAGCAAGCTGACCG<br>TTGACAAATCCAGGTGGCAACAGGGCAACGT<br>CTTCAGCTGCAGCGTGATGCATGAAGCGCTGC<br>ACAACCATTACACGCAGAAAAGCCTGTCCCTG<br>AGCCCCGGCAAGAGGAAGAAAAGGAGCCTGT<br>CCCAGGAGGACGCCCCTCAGACCCCGCGACC<br>CGTGGCCGAGATCGTGCCTAGCTTCATTAACA<br>AGGACACCGAGACGATCAACATGATGAGCGA<br>GTTCGTGGCCAATCTGCCCCAGGAGCTGAAGC<br>TCACCCTCAGCGAGATGCAGCCCGCCCTGCCC<br>CAGCTGCAGCAGCACGTCCCGGTCCTGAAGG<br>ACAGCAGCCTGCTGTTCGAGGAGTTCAAGAA<br>GCTGATCAGGAACAGGCAGAGCGAGGCCGCC<br>GACTCCTCCCCCTCCGAGCTGAAGTACCTCGG<br>CCTGGACACCCACTCCAGGAAGAAGCGGCAG<br>CTGTACTCAGCCCTGGCCAACAAGTGCTGCCA<br>CGTGGGCTGCACCAAGCGGAGCCTGGCCCGG<br>TTCTGC | | | |
| Construct 50 | ATGGGCGTGAAGGTGCTGTTCGCCCTCATCTG<br>CATCGCCGTGGCCGAGGCCGACAGCTGGATG<br>GAGGAGGTGATCAAACTCTGCGGCAGGGAGC<br>TCGTGCGCGCCCAGATCGCCATCTGCGGGATG<br>TCCACCTGGAGCGAGCCCAAGAGCTCCGACA<br>AAACCCACACCAGCCCGCCCAGCCCCC<br>GAGCTGCTGGGCGGCAGCAGCGTGTTCCTCTT<br>CCCTCCCAAGCCCAAGGACACGCTGTACATCA<br>CCCGGGAGCCCGAGGTGACCTGCGTGGTGGT<br>GGACGTGAGCCACGAGGACCCTGAAGTGAAG<br>TTTAACTGGTATGTTGACGGCGTGGAGGTGCA<br>CAACGCAAAGACCAAGCCCCGCGAGGAGCAG<br>TACAACAGCACCTACCGCGTCGTCAGCGTGCT<br>GACAGTCCTCCACCAGGATTGGCTGAACGGCA<br>AGGAGTACAAGTGCAAGGTGTCCAACAAGGC<br>CCTGCCCGCCCCGATCGAGAAGACCATTAGCA<br>AGGCCAAGGGGCAGCCAAGGGAGCCACAAGT<br>GTACACCCTGCCACCTTCCAGGGACGAGCTGA<br>CCAAGAATCAGGTCAGCCTGACCTGCCTGGTT<br>AAGGGCTTCTACCCCAAGCGACATCGCCGTTGA<br>GTGGGAGAGCAACGGACAGCCTGAGAACAAC<br>TATAAGACTACCCCTCCCGTGCTGGATTCCGA<br>CGGAAGCTTCTTCCTGTACAGCAAGCTGACCG<br>TGGACAAGAGCAGATGGCAGCAGGGTAACGT<br>GTTTTCCTGCTCCGTGATGCATGAGGCCCTGC<br>ACAACCACTACACCCAGAAAAGCCTCAGCCT<br>GAGCCCCGGCAAACGCAAGAAGCGGAGCCTG<br>TCGCAAGAGGACGCCCCCCAGACCCCCAGGC<br>CTGTGGCCGAGATCGTCCCCAGCTTCATCAAC<br>AAGGACACCGAGACTATCAACATGATGAGCG<br>AATTCGTGGCCAACCTCCCCCAGGAACTGAAG<br>CTGACCCTGAGCGAGATGCAGCCCGCCCTGCC<br>CCAGCTGCAGCAGCACGTGCCCGTACTGAAG<br>GACAGCTCCCTGCTGTTTGAAGAGTTTAAGAA<br>GCTGATCCGGAACAGGCAGTCCGAAGCCGCC<br>GACAGCTCCCCCAGCGAGCTGAAATACCTGG<br>GGCTGGACACCCACAGCCGGAAAAAGCGCCA<br>GCTCTACAGCGCCCTGGCCAACAAGTGCTGCC<br>ACGTGGGCTGCACCAAGCGTTCCCTGGCCCGG<br>TTTTGC | 5' UTR 1 | 3' UTR 1 | 212 |
| Construct 51 | ATGGGCGTGAAGGTCCTCTTCGCCCTCATCTG<br>CATCGCCGTGGCCGAGGCCGACTCCTGGATGG<br>AGGAGGTGATAAAGCTCTGCGGCAGGGAGCT | 5' UTR 1 | 3' UTR 1 | 213 |

TABLE 6-continued

DNA Sequences

| Name | ORF Sequence | 5' UTR | 3' UTR | SEQ ID NO: |
|---|---|---|---|---|
| | CGTGCGCGCCCAAATCGCCATCTGCGGGATGA GCACCTGGAGCGAGCCCAAGAGCTCCGACAA GACACACACCTCCCCGCCCAGCCCCGCCCCAG AGCTGCTGGGCGGGAGCAGCGTCTTTCTGTTC CCGCCCAAGCCCAAGGACACCCTGTACATCAC GCGCGAGCCCGAAGTGACCTGCGTGGTCGTG GACGTGAGCCACGAGGACCCTGAGGTGAAGT TCAACTGGTACGTGGACGGCGTGGAGGTGCA CAACGCTAAGACCAAGCCCCGGGAGGAGCAG TACAACTCAACCTACAGAGTGGTGAGCGTCCT CACGGTGCTGCACCAGGATTGGCTGAATGGCA AGGAGTATAAATGCAAGGTGAGCAACAAAGC ACTGCCCGCCCCCATCGAGAAGACAATCTCTA AGGCCAAGGGCCAGCCCAGGGAGCCCCAGGT GTACACCCTGCCCCCCTCAAGAGACGAGCTGA CCAAGAATCAGGTGTCCCTGACCTGCCTCGTG AAGGGCTTCTACCCCAGCGATATCGCTGTGGA GTGGGAGTCCAACGGGCAGCCGGAGAACAAC TACAAGACCACCCCACCCGTGCTGGACAGCG ACGGGAGCTTTTTCCTGTACAGCAAGCTGACC GTCGACAAGAGCAGATGGCAGCAGGGCAACG TGTTCAGCTGCAGCGTCATGCACGAGGCCCTG CACAACCACTACACACAAAAGAGCCTGAGCC TGTCGCCAGGCAAGCGAAAGAAGAGAAGCTT GAGCCAGGAGGACGCCCCCAGACCCCCCGG CCCGTGGCCGAGATCGTGCCCAGCTTCATCAA CAAGGACACCGAGACTATTAACATGATGAGC GAGTTCGTGGCCAATCTGCCCCAGGAGCTCAA ACTTACCCTGTCCGAGATGCAGCCCGCCCTGC CCCAGCTGCAGCAGCACGTGCCCGTGCTGAAG GACAGTTCCCTGCTGTTCGAGGAGTTCAAAAA GCTGATCCGCAACAGACAGAGCGAGGCCGCC GATAGCAGCCCCTCCGAGCTGAAGTACCTCGG CCTGGACACCCACAGCAGGAAGAAGAGGCAG CTGTACAGCGCCCTGGCCAATAAGTGCTGTCA CGTTGGCTGCACCAAGCGCAGCCTCGCCCGGT TTTGC | | | |
| Construct 52 | ATGGGCGTGAAGGTGCTGTTCGCCCTCATCTG CATTGCCGTGGCCGAAGCCGACAGCTGGATG GAAGAGGTCATCAAGCTCTGCGGCAGGGAGC TCGTGAGGGCCCAGATCGCCATCTGCGGCATG AGCACCTGGAGCGAGCCCAAGTCCAGCGACA AGACCCACACCAGCCCGCCCAGCCCCGCCCCG GAGCTTCTTGGGGGCAGCAGCGTGTTCCTGTT CCCACCCAAGCCCAAGGACACCCTGTACATCA CCCGGGAACCCGAGGTGACCTGCGTGGTCGTT GACGTCAGTCACGAGGATCCCGAAGTCAAGTT TAACTGGTATGTGGACGGCGTGGAGGTCCACA ATGCCAAAACCAAGCCACGGGAGGAACAGTA TAATTCCACCTACAGGGTGGTCAGCGTGCTCA CCGTGCTCCACCAGGACTGGCTCAACGGAAA GGAGTATAAGTGCAAGGTGAGCAATAAGGCC CTGCCTGCCCCCATCGAGAAGACCATCTCCAA GGCGAAAGGCCAGCCCCGGGAGCCTCAGGTC TACACCCTGCCCCCCAGCCGCGACGAGCTCAC CAAGAACCAGGTGAGCCTCACCTGCCTGGTGA AGGGCTTCTACCCCAGCGACATCGCCGTGGAG TGGGAGTCCAACGGACAGCCCGAGAACAACT ACAAGACCACCCCACCGGTCCTGGACAGCGA TGGCTCCTTCTTCCTGTACAGCAAACTGACCG TGGACAAGAGCCGGTGGCAGCAGGGCAACGT GTTCAGCTGCAGCGTCATGCACGAGGCGCTGC ACAATCACTACACCCAGAAATCCCTGAGCCTG TCCCCCGGCAAGAGGAAGAAGAGGAGCCTGA GCCAGGAGGACGCCCCCAGACACCCAGGCC CGTGGCCGAGATCGTGCCCTCCTTCATCAACA AGGATACCGAAACCATCAACATGATGAGCGA GTTCGTAGCCAACCTGCCGCAGGAGCTCAAGC TGACCCTGAGCGAGATGCAGCCCGCCCTGCCC CAGCTGCAACAGCACGTGCCCGTGCTCAAGG ACAGCAGCCTGCTGTTCGAGGAGTTCAAAAA GCTGATCCGTAACCGCCAGAGCGAGGCCGCC GATTCTAGCCCCTCCGAGCTGAAGTATCTGGG | 5' UTR 1 | 3' UTR 1 | 214 |

TABLE 6-continued

DNA Sequences

| Name | ORF Sequence | 5' UTR | 3' UTR | SEQ ID NO: |
|---|---|---|---|---|
| | ACTGGACACCCACTCCCGCAAGAAACGGCAG<br>CTTTATTCCGCCCTGGCCAACAAGTGCTGCCA<br>CGTGGGCTGCACCAAAAGGTCCCTGGCCAGGT<br>TTTGC | | | |
| Construct 53 | ATGGGCGTGAAAGTGCTCTTTGCCCTCATCTG<br>CATCGCCGTGGCCGAGGCCGACAGCTGGATG<br>GAGGAGGTGATAAAGCTCTGCGGGCGGGAGC<br>TCGTCCGGGCCCAGATCGCCATCTGCGGTATG<br>AGCACCTGGAGCGAGCCCAAGTCCAGCGACA<br>AGACCCACACCTCGCCCCCCAGCCCGGCCCCC<br>GAGCTGCTGGGGGAAGCAGCGTGTTCCTGTT<br>CCCGCCCAAGCCCAAGGACACCCTGTACATCA<br>CACGAGAGCCCGAAGTTACCTGCGTCGTGGTG<br>GACGTGAGCCACGAGGACCCCGAGGTGAAGT<br>TCAATTGGTACGTGGACGGAGTGGAGGTGCA<br>CAATGCAAAAACCAAGCCCCGAGAGGAGCAG<br>TACAATAGCACCTACAGGGTGGTGAGCGTGCT<br>GACTGTGCTGCACCAGGACTGGCTGAACGGG<br>AAGGAGTACAAGTGCAAGGTTAGCAACAAGG<br>CCCTCCCCGCCCCAATCGAGAAGACCATCTCC<br>AAGGCTAAGGGCCAGCCCAGGGAGCCCCAGG<br>TCTATACACTCCCGCCCAGCAGAGATGAGCTC<br>ACCAAGAACCAGGTCAGCCTGACCTGTCTGGT<br>GAAAGGCTTCTACCCCAGCGACATTGCCGTGG<br>AGTGGGAGTCCAACGGCCAGCCCGAGAACAA<br>CTACAAGACCACTCCCCCCGTACTGGATTCCG<br>ACGGCAGCTTCTTCCTGTACAGCAAGCTCACC<br>GTGGACAAATCCAGGTGGCAGCAGGGCAACG<br>TGTTTTCCTGCAGCGTAATGCATGAGGCCCTC<br>CACAACCACTACACCCAGAAAAGCCTGAGCC<br>TGAGCCCCGGGAAGAGGAAGAAGAGGAGCCT<br>GTCCAGGAGGACGCCCCCCAGACCCCCCAGG<br>CCCGTGGCCGAGATCGTCCCCAGCTTCATCAA<br>TAAGGACACGGAGACGATCAACATGATGAGC<br>GAATTCGTGGCAAACCTCCCCCAGGAGCTGAA<br>ACTGACGCTGAGCGAGATGCAGCCAGCCCTG<br>CCTCAGCTGCAGCAACATGTGCCCGTGCTGAA<br>GGACAGCTCCTTGCTGTTCGAGGAATTCAAGA<br>AGCTGATCCGGAACAGGCAGAGCGAGGCCGC<br>CGACTCCAGCCCCTCCGAGCTGAAGTACCTGG<br>GCCTGGACACCCACTCCCGAAAAAAGCGTCA<br>GCTGTACAGCGCCCTGGCGAACAAATGCTGCC<br>ATGTCGGCTGTACCAAGCGGTCCCTGGCCCGC<br>TTCTGC | 5' UTR 1 | 3' UTR 1 | 215 |
| Construct 54 | ATGGGGGTGAAGGTCCTCTTCGCGTTGATCTG<br>CATCGCCGTGGCCGAGGCCAGATAGCTGGATG<br>GAGGAGGTTATCAAGCTCTGTGGTCGCGAGCT<br>CGTGCGCGCCCAAATCGCCATCTGCGGCATGA<br>GCACCTGGAGCGAGCCGAAAAGCAGCGACAA<br>GACACACACCTCCCCTCCGAGCCCCGCTCCCG<br>AGCTTCTGGGTGGGTCCTCAGTGTTTCTGTTCC<br>CGCCCAAGCCAAAGGACACGCTGTACATCAC<br>CAGAGAGCCCGAAGTGACTTGCGTGGTGGTC<br>GACGTGTCCCACGAGGACCCTGAAGTCAAGTT<br>CAACTGGTACGTGGACGGCGTGGAGGTGCAC<br>AACGCCAAGACAAAGCCCCGGGAGGAACAGT<br>ACAACTCCACCTACCGGGTGGTGTCCGTGCTC<br>ACCGTGCTCCACCAGGACTGGCTGAACGGCA<br>AGGAGTACAAGTGCAAGGTGAGCAACAAGGC<br>TCTGCCCGCCCCCATCGAGAAGACGATCTCCA<br>AGGCCAAGGGGCAACCCAGGGAACCGCAGGT<br>CTATACCCTGCCCCCCTCTCGGGACGAGCTGA<br>CGAAGAACCAGGTTAGCCTCACCTGCCTGGTG<br>AAGGGCTTCTACCCCTCCGACATCGCCGTCGA<br>GTGGGAATCCAACGGGCAGCCTGAGAACAAT<br>TACAAGACCACCCCTCCCGTCCTGGACTCCGA<br>CGGCAGCTTCTTTCTCTACTCCAAGCTCACCGT<br>GGACAAGTCGAGGTGGCAGCAGGGAAACGTG<br>TTCTCCTGTAGCGTGATGCACGAGGCCCTGCA<br>CAACCACTACACCCAGAAAAGCCTGAGCCTC<br>AGCCCCGGGAAGCGGAAAAAGCGCTCCCTGT<br>CCCAGGAGGACGCCCCCCAGACACCCCGGCC | 5' UTR 1 | 3' UTR 1 | 216 |

TABLE 6-continued

DNA Sequences

| Name | ORF Sequence | 5' UTR | 3' UTR | SEQ ID NO: |
|---|---|---|---|---|
| | CGTGGCCGAGATCGTCCCTTCCTTCATCAATA<br>AAGACACCGAGACAATCAACATGATGAGCGA<br>GTTCGTGGCCAACCTGCCCCAGGAACTGAAGC<br>TGACCCTCTCGGAGATGCAGCCCGCGCTGCCG<br>CAGCTGCAGCAGCATGTGCCCGTGCTGAAAG<br>ACAGCAGCCTGCTGTTCGAGGAGTTTAAGAAG<br>CTCATCAGAAATAGACAGAGCGAGGCCGCCG<br>ATAGCTCCCCAAGCGAGCTCAAGTACCTCGGG<br>CTGGACACGCACAGCAGAAAGAAGAGACAGC<br>TGTACAGCGCCCTGGCCAATAAGTGCTGCCAC<br>GTCGGCTGCACCAAGCGGAGCTTGGCGAGGTT<br>CTGC | | | |
| Construct 55 | ATGGGCGTAAAGGTGCTCTTTGCCCTAATCTG<br>CATCGCCGTGGCCGAGGCCGACTCGTGGATGG<br>AGGAGGTGATCAAGCTCTGCGGCCGGGAGCT<br>CGTGCGCGCCCAGATCGCCATCTGCGGGATGA<br>GCACCTGGAGCGAGCCCAAAAGTTCCGACAA<br>GACCCACACCAGCCCGCCCAGCCCCGCCCCCG<br>AGCTGCTGGGAGGGAGCAGCGTGTTCCTGTTC<br>CCACCCAAGCCCAAGGACACCCTGTACATCAC<br>CCGCGAGCCCGAGGTGACCTGCGTGGTGGTG<br>GACGTGTCCCATGAGGATCCGGAGGTGAAGTT<br>CAACTGGTACGTGGACGGCGTGGAGGTGCAC<br>AACGCCAAAACCAAGCCCAGGGAGGAGCAGT<br>ACAATTCCACCTACAGGGTGGTGAGCGTCCTG<br>ACGGTCCTGCACCAAGACTGGCTGAATGGCA<br>AGGAGTACAAGTGCAAGGTGAGCAACAAGGC<br>CCTGCCCGCGCCTATCGAGAAGACGATCAGCA<br>AGGCCAAAGGCCAACCGAGGGAGCCCCAGGT<br>GTATACCCTGCCCCCCAGCAGGGACGAGCTCA<br>CCAAGAATCAAGTGTCACTGACCTGCCTGGTG<br>AAGGGCTTCTACCCCTCCGACATCGCTGTGGA<br>GTGGGAGAGCAACGGCCAGCCCGAAAATAAC<br>TACAAGACCACCCCGCCCGTGCTGGACAGCG<br>ACGGCAGTTTCTTTCTGTACAGCAAGCTGACC<br>GTGGACAAGTCCAGATGGCAGCAGGGCAACG<br>TGTTCAGCTGTAGCGTCATGCACGAGGCCCTG<br>CATAATCACTACACCCAGAAAAGCCTGTCCCT<br>GAGCCCAGGGAAGCGGAAGAAGCGATCCCTC<br>AGCCAGGAGGACGCCCCGCAGACCCCCAGAC<br>CCGTTGCCGAGATCGTGCCCTCATTCATCAAC<br>AAGGACACAGAGACAATCAACATGATGTCCG<br>AATTCGTGGCCAACCTCCCCCAGGAGCTCAAG<br>CTGACCCTCAGCGAGATGCAGCCCGCCCTGCC<br>CCAGCTGCAGCAGCATGTGCCCGTGCTGAAGG<br>ACTCGAGCCTGCTGTTCGAAGAGTTCAAGAAG<br>CTGATCAGAAATCGTCAGTCCGAGGCCGCCGA<br>CAGCAGCCCCAGCGAACTCAAGTACCTGGGC<br>CTGGACACCCACAGCCGCAAGAAGAGGCAGC<br>TGTACAGCGCCCTGGCCAACAAGTGCTGCCAC<br>GTGGGTTGCACCAAGCGCAGCTTGGCCAGGTT<br>TTGC | 5' UTR 1 | 3' UTR 1 | 217 |
| Construct 56 | ATGGGCGTGAAGGTGCTGTTCGCCCTCATTTG<br>TATCGCCGTGGCCGAAGCGGACAGCTGGATG<br>GAGGAGGTGATCAAACTATGCGGCAGGGAGC<br>TCGTGAGAGCTCAGATTGCCATCTGCGGCATG<br>TCGACCTGGAGCGAGCCCAAGAGCAGCGACA<br>AGACCCACACCTCCCCGCCCAGCCCCGCCCCC<br>GAGCTGCTGGGGGGCAGCAGCGTGTTCCTGTT<br>TCCCCCCAAGCCCAAGGACACCCTGTACATCA<br>CCCGAGAGCCCGAGGTGACCTGTGTGGTGGTG<br>GACGTTTCCCACGAGGACCCCGAGGTCAAGTT<br>CAACTGGTACGTGGATGGCGTGGAGGTGCAC<br>AATGCCAAGACTAAGCCCCGAGAGGAGCAGT<br>ACAACAGCACCTACAGGGTGGTCAGCGTGCT<br>GACCGTCCTGCACCAGGACTGGCTGAACGGG<br>AAGGAATACAAGTGCAAGGTAAGCAACAAGG<br>CCCTGCCTGCCCCCATCGAGAAGACCATTTCC<br>AAGGCCAAGGGCCAACCAAGGGAGCCCCAGG<br>TGTACACCCTGCCCCCAGCAGAGACGAACTG<br>ACCAAGAACCAGGTGAGCCTGACCTGCCTGGT<br>CAAGGGGTTCTACCCCTCCGACATCGCCGTGG | 5' UTR 1 | 3' UTR 1 | 218 |

TABLE 6-continued

DNA Sequences

| Name | ORF Sequence | 5' UTR | 3' UTR | SEQ ID NO: |
|---|---|---|---|---|
| | AGTGGGAGTCCAACGGCCAGCCCGAGAACAA CTACAAGACCACCCCGCCCGTCCTCGATAGCG ACGGGAGCTTCTTCCTGTACTCAAAGCTGACA GTGGACAAGAGCAGGTGGCAGCAGGGCAACG TGTTCTCCTGCAGCGTGATGCACGAAGCCCTG CATAACCACTATACCCAGAAGTCCCTGAGCCT GAGCCCCGGAAAGCGCAAAAAGCGCAGCCTG AGCCAGGAGGACGCCCCACAAACCCCCAGGC CCGTGGCCGAGATCGTGCCCAGCTTCATCAAC AAGGACACTGAGACGATCAACATGATGTCCG AGTTTGTGGCCAACCTGCCCCAGGAGCTGAAG CTGACCCTGTCTGAGATGCAGCCCGCCCTGCC TCAGCTCCAGCAGCACGTGCCCGTCCTCAAGG ACAGCAGCCTGCTGTTCGAGGAGTTTAAGAAG CTGATCCGGAACAGGCAGTCAGAGGCCGCCG ACAGCAGCCCCAGCGAGCTGAAGTACCTCGG CCTGGACACACATAGCCGGAAGAAGAGGCAG CTCTACAGCGCCCTCGCCAACAAATGCTGCCA CGTGGGCTGCACCAAGAGGAGCCTGGCCAGA TTCTGT | | | |
| Construct 57 | ATGGGCGTGAAGGTCCTCTTCGCCCTCATCTG CATCGCCGTGGCCGAGGCCGATAGCTGGATG GAGGAGGTCATCAAGCTCTGCGGGCGAGAGC TCGTGAGAGCCCAGATCGCCATCTGCGGCATG AGCACCTGGAGCGAGCCCAAGTCCTCGGACA AGACGCATACCAGCCCGCCCAGCCCCGCCCC GAGCTGCTGGGGGGCAGCAGCGTGTTCCTGTT CCCACCCAAGCCCAAGGACACCCTGTATATCA CCCGGGAACCTGAGGTGACATGCGTGGTGGT GGACGTAAGCCACGAGGACCCAGAGGTGAAG TTTAACTGGTACGTGGACGGGGTGGAGGTGCA CAATGCCAAGACCAAGCCTAGGGAGGAGCAA TACAACTCCACCTACCGCGTGGTGAGCGTGCT GACGGTCCTGCACCAGGACTGGCTGAACGGC AAAGAGTACAAGTGCAAAGTGTCCAACAAAG CCCTGCCCGCCCCCATCGAGAAGACCATCTCC AAGGCCAAGGGGCAGCCCAGAGAGCCCCAGG TGTACACCCTGCCCCCCTCTAGGGACGAGCTC ACCAAGAACCAGGTGAGCCTGACCTGCCTGGT GAAGGGCTTCTACCCGTCCGACATCGCCGTGG AGTGGGAGAGCAACGGCCAACCCGAGAACAA CTACAAGACCACCCCGCCGGTGCTCGACTCCG ACGGCAGCTTCTTCCTCTACAGCAAGCTAACC GTGGATAAGAGCCGCTGGCAGCAGGGCAACG TCTTCAGCTGCAGCGTCATGCACGAGGCCCTG CACAACCACTACACCCAGAAAAGCCTGTCCCT GTCCCCCGGCAAGCGGAAGAAGAGATCGCTG TCCCAGGAGGACGCCCCCCAAACGCCCAGGC CCGTAGCCGAGATCGTGCCCAGCTTCATCAAC AAGGACACCGAGACAATTAACATGATGAGTG AGTTTGTGGCCAATCTCCCCCAGGAGCTGAAG CTCACCCTGAGCGAGATGCAGCCCGCCCTCCC CCAGCTGCAGCAGCACGTGCCCGTGCTGAAG GACAGCTCCCTCCTGTTCGAAGAGTTCAAGAA GCTGATCAGGAACCGGCAGAGCGAGGCCGCC GACTCCAGCCCCAGCGAGCTGAAGTACCTGG GTCTGGATACCCACTCCAGGAAGAAGCGGCA GCTGTACAGCGCCCTGGCCAACAAGTGTTGTC ACGTCGGTTGCACGAAACGGTCGCTCGCCCGG TTTTGT | 5' UTR 1 | 3' UTR 1 | 219 |
| Construct 58 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCAGCCCCCCAAGCCCCGCTCCC GAGCTGCTGGGCGGCAGCAGCGTGTTCCTGTT CCCTCCTAAACCTAAGGACACCCTGTACATCA CCCGGGAGCCCGAGGTGACCTGCGTGGTGGT GGACGTGAGCCACGAGGACCCTGAGGTGAAG TTCAACTGGTACGTGGACGGCGTGGAGGTGCA CAACGCCAAGACCAAGCCACGGGAGGAGCAG | 5' UTR 1 | 3' UTR 1 | 220 |

TABLE 6-continued

DNA Sequences

| Name | ORF Sequence | 5' UTR | 3' UTR | SEQ ID NO: |
|---|---|---|---|---|
| | TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCTGCGCCCATCGAGAAGACCATCAGC AAGGCCAAGGGGCAGCCTAGAGAACCCCAGG TGTACACCCTGCCTCCCAGCCGGGACGAGCTG ACCAAGAACCAGGTGAGCCTGACCTGCCTGGT GAAGGGCTTCTACCCCAGCGATATTGCTGTGG AGTGGGAGAGCAACGGCCAGCCTGAGAACAA CTACAAGACCACCCCTCCCGTGCTGGACAGCG ACGGCAGCTTCTTCCTGTACAGCAAACTGACA GTGGACAAGAGCCGGTGGCAGCAGGGCAACG TGTTCAGCTGCAGCGTGATGCACGAAGCCCTG CACAACCACTACACCCAGAAAAGCCTAAGCC TGTCACCCGGCAAGCGGAAGAAGCGGTCCTT GAGCCAGGAGGACGCGCCTCAGACCCCCCGG CCTGTGGCTGAAATCGTGCCCAGCTTCATCAA CAAAGACACCGAGACGATAAACATGATGAGC GAGTTCGTGGCCAACCTGCCCCAGGAGCTGAA GCTCACCTTGAGCGAGATGCAGCCCGCTCTGC CACAACTCCAGCAGCACGTGCCCGTCCTTAAG GACAGCAGCCTGCTTTTCGAGGAGTTCAAGAA GCTGATCCGGAACCGGCAGAGCGAGGCCGCC GATAGCTCCCCTAGCGAGCTCAAGTACCTGGG CCTGGACACCCACAGCAGAAAGAAGCGCCAG CTGTATAGCGCCCTGGCCAACAAGTGCTGCCA CGTGGGATGCACAAAAAGAAGCTTGGCCCGG TTCTGC | | | |
| Construct 59 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCTCTCCTCCGTCCCCCGCTCCC GAGCTGCTGGGCGGCAGCAGCGTGTTCCTGTT CCCTCCCAAGCCCAAGGACACCCTGTACATCA CCCGGGAGCCCGAGGTGACCTGCGTGGTGGT GGACGTGAGCCACGAGGACCCTGAGGTGAAG TTCAACTGGTACGTGGACGGCGTGGAGGTGCA CAACGCCAAGACCAAGCCCCGGGAGGAGCAG TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCAGCCCCTATCGAGAAGACCATCAGC AAGGCCAAGGGGCAGCCCAGGGAGCCACAGG TGTACACCCTGCCGCCCAGCCGGGACGAGCTG ACCAAGAACCAGGTGAGCCTGACCTGCCTGGT GAAGGGCTTCTACCCCAGCGACATCGCTGTGG AGTGGGAGAGCAACGGCCAGCCGGAGAACAA CTACAAGACCACCCCACCCGTGCTGGACAGCG ACGGCAGCTTCTTCCTGTACAGCAAGCTCACC GTAGACAAGAGCCGGTGGCAGCAGGGCAACG TGTTCAGCTGCAGCGTGATGCACGAGGCCCTA CACAACCACTACACCCAGAAAAGCCTGAGCC TATCCCCCGGCAAGCGGAAGAAGAGATCGCT GAGCCAGGAGGACGCCCCCAGACCCCCCGG CCCGTAGCCGAGATCGTGCCCAGCTTCATCAA CAAAGACACTGAAACGATCAACATGATGAGC GAGTTCGTGGCCAACCTGCCCCAGGAGCTGAA GCTCACACTGAGCGAGATGCAGCCCGCTCTGC CACAGCTCCAGCAGCACGTGCCCGTCCTGAAG GACAGCAGCCTGCTTTTCGAGGAGTTCAAGAA GCTGATCCGGAACCGGCAGAGCGAGGCCGCT GACAGCTCACCCAGTGAACTTAAGTACCTGGG CCTGGACACCCACAGCCGCAAGAAGCGGCAG CTGTACTCCGCCCTGGCCAACAAGTGCTGCCA CGTGGGGTGCACCAAACGCAGCCTGGCCCGG TTCTGC | 5' UTR 1 | 3' UTR 1 | 221 |
| Construct 60 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG | 5' UTR 1 | 3' UTR 1 | 222 |

TABLE 6-continued

DNA Sequences

| Name | ORF Sequence | 5' UTR | 3' UTR | SEQ ID NO: |
|---|---|---|---|---|
| | AGCACCTGGAGCGAGCCCAAGAGCAGCGACA<br>AGACCCACACCTCCCCACCTAGCCCAGCCCCC<br>GAGCTGCTGGGCGGCAGCAGCGTGTTCCTGTT<br>CCCACCCAAGCCCAAGGACACCCTGTACATCA<br>CCCGGGAGCCCGAGGTGACCTGCGTGGTGGT<br>GGACGTGAGCCACGAGGACCCCGAGGTCAAG<br>TTCAACTGGTACGTGGACGGCGTGGAGGTGCA<br>CAACGCCAAGACCAAGCCCCGGGAGGAGCAG<br>TACAACAGCACCTACCGGGTGGTGAGCGTGCT<br>GACCGTGCTGCACCAGGACTGGCTGAACGGC<br>AAGGAGTACAAGTGCAAGGTGAGCAACAAGG<br>CCCTGCCCGCTCCCATCGAGAAGACCATCAGC<br>AAGGCCAAGGGCCAGCCCAGGGAGCCCCAGG<br>TGTACACCCTGCCTCCCAGCCGGGACGAGCTG<br>ACCAAGAACCAGGTGAGCCTGACCTGCCTGGT<br>GAAGGGCTTCTACCCCAGCGACATCGCTGTCG<br>AGTGGGAGAGCAACGGACAGCCCGAGAACAA<br>CTACAAGACCACCCCTCCCGTGCTGGACAGCG<br>ACGGCAGCTTCTTCCTGTACAGCAAACTGACT<br>GTGGACAAGAGCCGGTGGCAGCAGGGCAACG<br>TGTTCAGCTGCAGCGTGATGCACGAGGCCTTG<br>CACAACCACTACACCCAGAAAAGCCTGTCCCT<br>GTCCCCCGGCAAGCGGAAGAAGCGGTCACTG<br>TCCCAGGAGGACGCTCCGCAGACCCCCCGGCC<br>AGTGGCGGAGATCGTGCCCAGCTTCATCAATA<br>AGGATACCGAGACAATTAACATGATGAGCGA<br>GTTCGTGGCCAACCTGCCCCAGGAGCTGAAGC<br>TGACCCTGAGCGAGATGCAGCCCGCTCTGCCG<br>CAGTTACAGCAGCACGTGCCCGTCCTGAAGGA<br>CAGCAGCCTGCTGTTTGAGGAGTTCAAGAAGC<br>TGATCCGGAACCGGCAGAGCGAGGCCGCCGA<br>TAGCTCCCCATCTGAGCTCAAGTACCTGGGCC<br>TGGACACCCACAGCAGAAAGAAAAGGCAGCT<br>GTACTCCGCCCTGGCCAACAAGTGCTGCCACG<br>TGGGATGCACCAAGAGATCTCTGGCCCGGTTC<br>TGC | | | |
| Construct 61 | ATGGGCGTGAAGGTGCTGTTCGCCCTGATCTG<br>CATCGCCGTGGCCGAGGCCGACAGCTGGATG<br>GAGGAGGTGATCAAGCTGTGCGGCCGGGAGC<br>TGGTGCGGGCCCAGATCGCCATCTGCGGCATG<br>AGCACCTGGAGCGAGCCCAAGAGCAGCGACA<br>AGACCCACACCTCACCTCCATCCCCGGCACCC<br>GAGCTGCTGGGCGGCAGCAGCGTGTTCCTGTT<br>CCCTCCCAAGCCCAAGGACACCCTGTACATCA<br>CCCGGGAGCCCGAGGTGACCTGCGTGGTGGT<br>GGACGTGAGCCACGAGGACCCCGAAGTGAAG<br>TTCAACTGGTACGTGGACGGCGTGGAGGTGCA<br>CAACGCCAAGACCAAGCCCCGGGAGGAGCAG<br>TACAACAGCACCTACCGGGTGGTGAGCGTGCT<br>GACCGTGCTGCACCAGGACTGGCTGAACGGC<br>AAGGAGTACAAGTGCAAGGTGAGCAACAAGG<br>CCCTGCCTGCGCCTATCGAGAAGACCATCAGC<br>AAGGCCAAGGGCCAGCCACGGGAACCCCAGG<br>TGTACACCCTGCCTCCCAGCCGGGACGAGCTG<br>ACCAAGAACCAGGTGAGCCTGACCTGCCTGGT<br>GAAGGGCTTCTACCCCAGCGATATCGCTGTGG<br>AGTGGGAGAGCAACGGCCAACCCGAGAACAA<br>CTACAAGACCACCCCACCCGTGCTGGACAGCG<br>ACGGCAGCTTCTTCCTGTACAGCAAACTAACC<br>GTGGACAAGAGCCGGTGGCAGCAGGGCAACG<br>TGTTCAGCTGCAGCGTGATGCACGAAGCCCTG<br>CACAACCACTACACCCAGAAAAGCCTCTCCCT<br>GAGCCCCGGCAAGCGGAAGAAGCGGTCCTTG<br>TCACAGGAGGACGCCCCCCAGACCCCCCGGCC<br>CCGTCGCTGAGATCGTGCCCAGCTTCATCAAC<br>AAAGACACCGAAACAATTAACATGATGAGCG<br>AGTTCGTGGCCAACCTGCCCCAGGAGCTGAAG<br>CTGACACTGAGCGAGATGCAGCCCGCTCTGCC<br>ACAACTGCAGCAGCACGTGCCAGTGCTCAAG<br>GACAGCAGCCTCCTGTTCGAGGAGTTCAAGAA<br>GCTGATCCGGAACCGGCAGAGCGAGGCCGCG<br>GACAGCTCACCAAGCGAGCTGAAATACCTGG<br>GCCTGGACACCCACAGCCGCAAAAAGAGACA | 5' UTR 1 | 3' UTR 1 | 223 |

TABLE 6-continued

| | DNA Sequences | | | |
|---|---|---|---|---|
| Name | ORF Sequence | 5' UTR | 3' UTR | SEQ ID NO: |
| | GCTGTACTCCGCCCTGGCCAACAAGTGCTGCC ACGTGGGATGCACCAAAAGAAGCCTGGCCCG GTTCTGC | | | |
| Construct 62 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCAGCCCCCCTTCCCCCGCCCCC GAGCTGCTGGGCGGCAGCAGCGTGTTCCTGTT CCCGCCCAAGCCCAAGGACACCCTGTACATCA CCCGGGAGCCCGAGGTGACCTGCGTGGTGGT GGACGTGAGCCACGAGGACCCCGAAGTGAAG TTCAACTGGTACGTGGACGGCGTGGAGGTGCA CAACGCCAAGACCAAGCCCCGGGAGGAGCAG TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCCGCTCCCATCGAGAAGACCATCAGC AAGGCCAAGGGCCAGCCAAGAGAACCCCAGG TGTACACCCTGCCCCCCTCCCGGGACGAGCTG ACCAAGAACCAGGTGAGCCTGACCTGCCTGGT GAAGGGCTTCTACCCCAGCGACATTGCCGTGG AGTGGGAGAGCAACGGCCAGCCCGAGAACAA CTACAAGACCACCCCACCCGTGCTGGACAGCG ACGGCAGCTTCTTCCTGTACAGCAAGCTGACT GTGGACAAGAGCCGGTGGCAGCAGGGCAACG TGTTCAGCTGCAGCGTGATGCACGAGGCCTTG CACAACCACTACACCCAGAAAAGCCTGTCCCT TAGCCCCGGCAAGCGGAAGAAGAGGAGCCTT AGCCAGGAGGACGCCCCACAGACCCCCCGGC CCGTGGCTGAAATCGTGCCCAGCTTCATCAAC AAAGACACAGAAACCATCAACATGATGAGCG AGTTCGTGGCCAACCTGCCCCAGGAGCTGAAG CTCACCCTGAGCGAGATGCAGCCCGCATTGCC ACAGCTCCAGCAGCACGTGCCTGTGCTGAAGG ACAGCAGCTTGCTCTTTGAGGAGTTCAAGAAG CTGATCCGGAACCGGCAGAGCGAGGCCGCCG ACTCCAGCCCCTCTGAGTTAAAGTACCTGGGC CTGGACACCCACAGCAGAAAGAAGCGGCAGC TGTACTCAGCCCTGGCCAACAAGTGCTGCCAC GTGGGCTGCACAAAGCGGAGCCTGGCCCGGT TCTGC | 5' UTR 1 | 3' UTR 1 | 224 |
| Construct 63 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCAGCCCCCCAAGCCCCGCCCCC GAGCTGCTGGGCGGCAGCAGCGTGTTCCTGTT CCCGCCCAAGCCCAAAGGACACCCTGTACATCA CCCGGGAGCCCGAGGTGACCTGCGTGGTGGT GGACGTGAGCCACGAGGACCCCAGAAGTCAAG TTCAACTGGTACGTGGACGGCGTGGAGGTGCA CAACGCCAAGACCAAGCCACGGGAGGAGCAG TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCTGCACCCATCGAGAAGACCATCAGC AAGGCCAAGGGGCAGCCTAGAGAGCCCCAGG TGTACACCCTGCCACCTAGCGGGACGAGCTG ACCAAGAACCAGGTGAGCCTGACCTGCCTGGT GAAGGGCTTCTACCCCAGCGACATCGCTGTGG AGTGGGAGAGCAACGGCCAGCCTGAGAACAA CTACAAGACCACCCCGCCCGTGCTGGACAGCG ACGGCAGCTTCTTCCTGTACAGCAAGCTCACG GTAGACAAGAGCCGGTGGCAGCAGGGCAACG TGTTCAGCTGCAGCGTGATGCACGAAGCTCTG CACAACCACTACACGCAGAAAAGCTTGAGCC TGTCACCCGGCAAGCGGAAGAAGCGGTCCCT GTCCCAGGAGGACGCCCCTCAGACCCCCCGGC CAGTAGCGGAGATCGTGCCCAGCTTCATCAAC | 5' UTR 1 | 3' UTR 1 | 225 |

TABLE 6-continued

| Name | ORF Sequence | 5' UTR | 3' UTR | SEQ ID NO: |
|---|---|---|---|---|
| | AAGGATACAGAGACTATCAACATGATGAGCG AGTTCGTGGCCAACCTGCCCCAGGAGCTGAAG CTGACTCTGAGCGAGATGCAGCCCGCGCTGCC TCAACTGCAGCAGCACGTGCCCGTACTGAAGG ACAGCAGCTTGCTCTTTGAGGAGTTCAAGAAG CTGATCCGGAACCGGCAGAGCGAGGCCGCAG ACAGCTCACCCAGCGAATTGAAGTACCTGGGC CTGGACACCCACAGCAGAAAGAAGCGACAGT TGTACTCCGCCCTGGCCAACAAGTGCTGCCAC GTGGGTTGCACCAAGAGGTCGCTGGCCCCGGTT CTGC | | | |
| Construct 64 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCTCACCACCAAGCCCTGCACCC GAGCTGCTGGGCGGCAGCAGCGTGTTCCTGTT CCCTCCCAAGCCCAAGGACACCCTGTACATCA CCCGGGAGCCCGAGGTGACCTGCGTGGTGGT GGACGTGAGCCACGAGGACCCAGAGGTCAAG TTCAACTGGTACGTGGACGGCGTGGAGGTGCA CAACGCCAAGACCAAACCCCGGGAGGAGCAG TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCGGCCCCTATCGAGAAGACCATCAGC AAGGCCAAGGGCCAGCCAAGGGAACCCCAGG TGTACACCCTGCCACCCAGCCGGGACGAGCTG ACCAAGAACCAGGTGAGCCTGACCTGCCTGGT GAAGGGCTTCTACCCCAGCGACATCGCAGTGG AGTGGGAGAGCAACGGCCAGCCCGAGAACAA CTACAAGACCACCCCACCCGTGCTGGACAGCG ACGGCAGCTTCTTCCTGTACAGCAAGCTGACT GTCGACAAGAGCCGGTGGCAGCAGGGCAACG TGTTCAGCTGCAGCGTGATGCACGAGGCCTTG CACAACCACTACACCCAGAAAAGCCTCTCTCT TTCTCCCGGCAAGCGGAAGAAGAGGAGCCTG TCCCAGGAGGACGCCCCCCAAACTCCCCGGCC CGTCGCTGAGATCGTGCCCAGCTTCATCAATA AAGACACGGAGACAATCAACATGATGAGCGA GTTCGTGGCCAACCTGCCCCAGGAGCTGAAGC TGACACTGAGCGAGATGCAGCCCGCACTTCCC CAGCTCCAGCAGCACGTGCCCGTCCTGAAGGA CAGCAGCTTACTCTTCGAGGAGTTCAAGAAGC TGATCCGGAACCGGCAGAGCGAGGCCGCAGA TTCTAGCCCCTCCGAACTCAAATACCTGGGCC TGGACACCCACAGCAGAAAGAAAAGACAGCT GTATTCAGCCCTGGCCAACAAGTGCTGCCACG TGGGCTGCACAAAGCGGAGCCTCGCCCGGTTC TGC | 5' UTR 1 | 3' UTR 1 | 226 |
| Construct 65 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCTCCCCTCCCAGTCCTGCCCCC GAGCTGCTGGGCGGCAGCAGCGTGTTCCTGTT CCCGCCCAAGCCCAAGGACACCCTGTACATCA CCCGGGAGCCCGAGGTGACCTGCGTGGTGGT GGACGTGAGCCACGAGGACCCTGAGGTGAAG TTCAACTGGTACGTGGACGGCGTGGAGGTGCA CAACGCCAAGACCAAGCCCCGGGAGGAGCAG TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCCGCCCCCAATCGAGAAGACCATCAGC AAGGCCAAGGGCCAGCCTAGGGAGCCGCAGG TGTACACCCTGCCACCCTCTCGGGACGAGCTG ACCAAGAACCAGGTGAGCCTGACCTGCCTGGT GAAGGGCTTCTACCCCAGCGATATCGCCGTCG AGTGGGAGAGCAACGGCCAACCTGAGAACAA | 5' UTR 1 | 3' UTR 1 | 227 |

TABLE 6-continued

| | DNA Sequences | | | |
|---|---|---|---|---|
| Name | ORF Sequence | 5' UTR | 3' UTR | SEQ ID NO: |
| | CTACAAGACCACCCCTCCCGTGCTGGACAGCG ACGGCAGCTTCTTCCTGTACAGCAAGCTCACC GTGGACAAGAGCCGGTGGCAGCAGGGCAACG TGTTCAGCTGCAGCGTGATGCACGAAGCCCTG CACAACCACTACACCCAGAAAAGCTTGAGCCT CAGTCCCGGCAAGCGGAAGAAGCGATCCTTG AGCCAGGAGGACGCTCCTCAGACCCCCCGGC CTGTGGCGGAGATCGTGCCCAGCTTCATCAAC AAAGACACTGAAACCATTAACATGATGAGCG AGTTCGTGGCTAACTTGCCCCAGGAGCTGAAG CTGACTCTGAGCGAGATGCAGCCCGCTCTCCC GCAGCTTCAGCAGCACGTGCCCGTGTTGAAGG ACAGCAGCCTCCTCTTCGAGGAGTTCAAGAAG CTGATCCGGAACCGGCAGAGCGAGGCCGCTG ATTCTTCCCCTAGCGAACTGAAATACCTGGGC CTGGACACCCACAGCAGAAAGAAGAGGCAGC TGTACTCTGCCCTGGCCAACAAGTGCTGCCAC GTGGGCTGCACAAAGAGGAGCCTGGCCCCGGT TCTGC | | | |
| Construct 66 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCTCCCTCCGTCCCCCGCTCCC GAGCTGCTGGGCGGCAGCAGCGTGTTCCTGTT CCCTCCCAAGCCCAAGGACACCCTGTACATCA CCCGGGAGCCCGAGGTGACCTGCGTGGTGGT GGACGTGAGCCACGAGGACCCCGAAGTCAAG TTCAACTGGTACGTGGACGGCGTGGAGGTGCA CAACGCCAAGACCAAGCCCCGGGAGGAGCAG TACAACAGCACCTACCGGGTGGTGAGCGTGCT GACCGTGCTGCACCAGGACTGGCTGAACGGC AAGGAGTACAAGTGCAAGGTGAGCAACAAGG CCCTGCCTGCTCCTATCGAGAAGACCATCAGC AAGGCCAAGGGCCAGCCTCGGGAACCCCAGG TGTACACCCTGCCCCCTAGCCGGGACGAGCTG ACCAAGAACCAGGTGAGCCTGACCTGCCTGGT GAAGGGCTTCTACCCCAGCGATATTGCCGTGG AGTGGGAGAGCAACGGGCAGCCCGAGAACAA CTACAAGACCACCCCGCCCGTGCTGGACAGCG ACGGCAGCTTCTTCCTGTACAGCAAGCTTACC GTCGACAAGAGCCGGTGGCAGCAGGGCAACG TGTTCAGCTGCAGCGTGATGCACGAAGCCCTG CACAACCACTACACCCAGAAAAGCCTCTCCCT GTCTCCCGGCAAGCGGAAGAAGCGCAGTCTCT CTCAGGAGGACGCTCCTCAGACCCCCCGGCCC GTCGCCGAAATCGTGCCCAGCTTCATCAACAA AGACACTGAAACCATAAACATGATGAGCGAG TTCGTGGCCAACCTGCCCCAGGAGCTGAAGTT GACTCTGAGCGAGATGCAGCCCGCCCTGCCAC AGCTCCAGCAGCACGTGCCCGTCCTGAAGGAC AGCAGCCTGTTGTTCGAGGAGTTCAAGAAGCT GATCCGGAACCGGCAGAGCGAGGCCGCCGAT TCCAGCCCCTCTGAGCTCAAGTACCTGGGCCT GGACACCCACAGCCGGAAGAAAAGGCAGTTA TACAGCGCCCTGGCCAACAAGTGCTGCCACGT GGGATGTACCAAGAGGAGTCTGGCCCGGTTCT GC | 5' UTR 1 | 3' UTR 1 | 228 |
| Construct 67 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGAGCCCAAGAGCAGCGACA AGACCCACACCAGTCCCCCCTCTCCCGCACCC GAGCTGCTGGGCGGCAGCAGCGTGTTCCTGTT CCCTCCCAAGCCCAAGGACACCCTGTACATCA CCCGGGAGCCCGAGGTGACCTGCGTGGTGGT GGACGTGAGCCACGAGGACCCCGAGGTCAAG TTCAACTGGTACGTGGACGGCGTGGAGGTGCA CAACGCCAAGACCAAGCCCCGGGAGGAGCAG TACAACAGCACCTACCGGGTGGTGAGCGTGCT | 5' UTR 1 | 3' UTR 1 | 229 |

TABLE 6-continued

DNA Sequences

| Name | ORF Sequence | 5' UTR | 3' UTR | SEQ ID NO: |
|---|---|---|---|---|
| | GACCGTGCTGCACCAGGACTGGCTGAACGGC<br>AAGGAGTACAAGTGCAAGGTGAGCAACAAGG<br>CCCTGCCGGCGCCAATCGAGAAGACCATCAG<br>CAAGGCCAAGGGTCAGCCCAGGGAGCCCCAG<br>GTGTACACCCTGCCTCCCTCTCGGGACGAGCT<br>GACCAAGAACCAGGTGAGCCTGACCTGCCTG<br>GTGAAGGGCTTCTACCCCAGCGACATCGCTGT<br>GGAGTGGGAGAGCAACGGCCAGCCCGAGAAC<br>AACTACAAGACCACCCCTCCCGTGCTGGACAG<br>CGACGGCAGCTTCTTCCTGTACAGCAAGCTGA<br>CAGTGGACAAGAGCCGGTGGCAGCAGGGCAA<br>CGTGTTCAGCTGCAGCGTGATGCACGAGGCCT<br>TGCACAACCACTACACCCAGAAAAGCCTGAG<br>CCTCTCCCCCGGCAAGCGGAAGAAGAGGAGC<br>CTCAGCCAGGAGGACGCTCCCCAGACCCCCCG<br>GCCAGTGGCCGAAATCGTGCCCAGCTTCATCA<br>ACAAGGATACAGAGACAATTAACATGATGAG<br>CGAGTTCGTGGCCAACCTGCCCCAGGAGCTGA<br>AGCTCACACTGAGCGAGATGCAGCCCGCCCTG<br>CCACAGTTGCAGCAGCACGTGCCCGTACTCAA<br>GGACAGCAGCCTCCTTTTCGAGGAGTTCAAGA<br>AGCTGATCCGGAACCGGCAGAGCGAGGCCGC<br>CGACAGTAGCCCAAGCGAACTCAAGTACCTG<br>GGCCTGGACACCCACAGCAGGAAAAAGAGAC<br>AGCTGTATAGCGCCCTGGCCAACAAGTGCTGC<br>CACGTGGGCTGTACCAAGCGGAGCTTGGCCCG<br>GTTCTGC | | | |
| Construct 68 | ATGGGCGTGAAGGTGCTGTTCGCCCTGATCTG<br>CATCGCCGTGGCCGAGGCCGACAGCTGGATG<br>GAGGAGGTGATCAAGCTGTGCGGCCGGGAGC<br>TGGTGCGGGCCCAGATCGCCATCTGCGGCATG<br>AGCACCTGGAGCGGAGGTGGTGGCTCAGGCG<br>GCGGGGGATCCGGCGGTGGTGGTAGCGGCGG<br>AGGCGGGTCTGGTGGCGGCGGTTCAGGGGGA<br>GGGGGCAGTGGGGGAGGAGGCTCTTTCCAGA<br>GCTCCTCCTCCAAGGCCCCACCCCCTAGCCTG<br>CCCAGCCCAGCCGGCTGCCCGGCCCCAGCGA<br>CACCCCCATCCTGCCCCAAGGAGGGGGTGGCT<br>CCGGGGGCGGTGGATCGGGTGGAGGCGGCTC<br>AGGTGGCGGGGGTTCTGGGGGGGGCGGATCT<br>GGCGGAGGAGGGTCGGGGGGTGGGGGATCAC<br>AGCTGTACAGCGCCCTGGCCAACAAGTGCTGC<br>CACGTGGGCTGCACCAAGCGGAGCCTGGCCC<br>GGTTCTGC | 5' UTR 1 | 3' UTR 1 | 230 |
| Construct 69 | ATGGGCGTGAAGGTGCTGTTCGCCCTGATCTG<br>CATCGCCGTGGCCGAGGCCGACAGCTGGATG<br>GAGGAGGTGATCAAGCTGTGCGGCCGGGAGC<br>TGGTGCGGGCCCAGATCGCCATCTGCGGCATG<br>AGCACCTGGAGCGGCGGCGGGGGGTCAGGGG<br>GAGGAGGGTCCGGGGGAGGCGGGAGCGGTGG<br>AGGCGGCTCCGGTGGTGGGGGTTCTGGCGGC<br>GGTGGCAGTGGGGGAGGGGATCCTTCCAGA<br>GCTCATCCTCCAAGGCTCCTCCCCCGAGCCTG<br>CCCAGCCCCAGCCGGCTGCCCGGCCCCAGCGA<br>CACCCCCATCCTGCCCCAGGGGGGCGGCGGCT<br>CAGGCGGGGGTGGTAGTGGCGGAGGAGGATC<br>TGGAGGGGGCGGGTCAGGAGGGGTGGAAGC<br>GGGGGGGGTGGCTCTGGTGGCGGGGGCTCTC<br>AGCTGTACAGCGCCCTGGCCAACAAGTGCTGC<br>CACGTGGGCTGCACCAAGCGGAGCCTGGCCC<br>GGTTCTGC | 5' UTR 1 | 3' UTR 1 | 231 |
| Construct 70 | ATGGGCGTGAAGGTGCTGTTCGCCCTGATCTG<br>CATCGCCGTGGCCGAGGCCGACAGCTGGATG<br>GAGGAGGTGATCAAGCTGTGCGGCCGGGAGC<br>TGGTGCGGGCCCAGATCGCCATCTGCGGCATG<br>AGCACCTGGAGCGGAGGGGTGGATCTGGGG<br>GGGGCGGCAGCGGTGGGGGCGGGTCCGGCGG<br>AGGTGGAAGTGCGCGGGGGGGTTCAGGAGGG<br>GGAGGCTCTGGAGGCGGAGGAAGTTTCCAGA<br>GCTCCTCCTCAAAGGCGCCTCCCCCAAGCCTG<br>CCCAGCCCCAGCCGGCTGCCCGGCCCCAGCGA | 5' UTR 1 | 3' UTR 1 | 232 |

TABLE 6-continued

DNA Sequences

| Name | ORF Sequence | 5' UTR | 3' UTR | SEQ ID NO: |
|---|---|---|---|---|
| | CACCCCCATCCTGCCCCAAGGTGGCGGTGGTA GCGGGGGTGGTGGGTCAGGCGGCGGCGGATC GGGTGGCGGAGGGTCTGGTGGAGGTGGGAGC GGCGGGGGCGGTAGCGGCGGTGGCGGCTCCC AGCTGTACAGCGCCCTGGCCAACAAGTGCTGC CACGTGGGCTGCACCAAGCGGAGCCTGGCCC GGTTCTGC | | | |
| Construct 71 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGTGGCGGCGGATCTGGCG GTGGGGGGTCGGTGGGGGAGGTTCCGGGGG AGGCGGTTCAGGGGGCGGGGGCTCAGGCGGT GGTGGAAGTGGGGGCGGCGGCAGTTTCCAGA GCTCCAGCTCCAAGGCCCCGCCTCCCAGCCTG CCCAGCCCCAGCCGGCTGCCCGGCCCCAGCGA CACCCCCATCCTGCCCCAGGGAGGGGGAGGG TCAGGAGGCGGAGGGTCCGGGGGTGGAGGAT CGGGAGGTGGCGGTAGCGGCGGGGGGGCAG CGGAGGCGGGGATCTGGTGGTGGGGGTTCT CAGCTGTACAGCGCCCTGGCCAACAAGTGCTG CCACGTGGGCTGCACCAAGCGGAGCCTGGCC CGGTTCTGC | 5' UTR 1 | 3' UTR 1 | 233 |
| Construct 72 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGCGGCGGTGGCAGTGGGG GCGGAGGGTCTGGTGGTGGGGGCTCTGGCGG GGGAGGAAGTGGAGGGGGCGGCTCTGGAGGT GGAGGCTCAGGTGGGGGTGGGAGCTTCCAGA GCTCTAGCAGCAAGGCGCCACCCCCAAGCCTG CCCAGCCCCAGCCGGCTGCCCGGCCCCAGCGA CACCCCCATCCTGCCCCAGGGCGGCGAGGTT CTGGGGGAGGGGGTTCCGGCGGGGGGGCAG CGGAGGGGGGGTAGCGGGGGTGGCGGGAGC GGAGGAGGGGGATCCGGTGGCGGAGGATCCC AGCTGTACAGCGCCCTGGCCAACAAGTGCTGC CACGTGGGCTGCACCAAGCGGAGCCTGGCCC GGTTCTGC | 5' UTR 1 | 3' UTR 1 | 234 |
| Construct 73 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGTGGAGGGGGGTCAGGGG GAGGGGGCTCCGGCGGGGGAGGCTCGGGAGG AGGCGGTTCAGGTGGGGGCGGCTCTGGTGGA GGCGGATCCGGTGGCGGGGGGAGCTTCCAGA GCAGCTCGTCCAAGGCCCCTCCCCCAAGCCTG CCCAGCCCCAGCCGGCTGCCCGGCCCCAGCGA CACCCCCATCCTGCCCCAGGGTGGGGGAGGA AGCGGAGGTGGTGGCTCCGGGGGCGGTGGCA GTGGCGGAGGGGGTTCTGGGGGGGGCGGGTC GGGTGGAGGTGGAAGCGGGGGTGGTGGATCC CAGCTGTACAGCGCCCTGGCCAACAAGTGCTG CCACGTGGGCTGCACCAAGCGGAGCCTGGCC CGGTTCTGC | 5' UTR 1 | 3' UTR 1 | 235 |
| Construct 74 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGGGGTGGTGGATCAGGTG GAGGCGGCAGTGGCGGGGGCGGTTCTGGGGG AGGAGGGTCGGGAGGGGGGGGGATCTGGTGGT GGCGGAAGTGGCGGCGGTGGATCCTTCCAGA GCAGTAGCTCTAAGGCCCCACCGCCCAGCCTG CCCAGCCCCAGCCGGCTGCCCGGCCCCAGCGA CACCCCCATCCTGCCCCAGGGTGGGGGTGGCT CCGGCGGCGGAGGCTCTGGGGGCGGCGGGAG | 5' UTR 1 | 3' UTR 1 | 236 |

TABLE 6-continued

DNA Sequences

| Name | ORF Sequence | 5' UTR | 3' UTR | SEQ ID NO: |
|---|---|---|---|---|
| | CGGAGGGGGCGGGTCAGGCGGGGGGGCTCA GGGGGAGGTGGGTCCGGTGGAGGTGGAAGTC AGCTGTACAGCGCCCTGGCCAACAAGTGCTGC CACGTGGGCTGCACCAAGCGGAGCCTGGCCC GGTTCTGC | | | |
| Construct 75 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGCGGAGGTGGATCAGGCG GCGGTGGGTCCGGGGGTGGCGGGTCAGGGGG CGGAGGGTCCGGCGGCGGGGGAAGCGGTGGC GGTGGCTCCGGAGGAGGAGGCTCTTTCCAGA GCTCCTCATCTAAGGCCCCGCCGCCCAGCCTG CCCAGCCCCAGCCGGCTGCCCGGCCCCAGCGA CACCCCCATCCTGCCCCAGGGCGGTGGAGGCA GTGGTGGGGAGGGAGTGGAGGCGGGGGGAG TGGGGGCGGGGGTTCGGGTGGTGGAGGTAGC GGGGGCGGCGGATCTGGTGGCGGAGGAAGCC AGCTGTACAGCGCCCTGGCCAACAAGTGCTGC CACGTGGGCTGCACCAAGCGGAGCCTGGCCC GGTTCTGC | 5' UTR 1 | 3' UTR 1 | 237 |
| Construct 76 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGGGAGGTGGGTCAGGTG GCGGGGGATCCGGCGGAGGGGGTTCAGGAGG CGGCGGGAGCGGAGGTGGTGGTTCGGGTGGA GGGGGGAGCGGTGGCGGAGGAAGCTTCCAGA GCTCCTCCTCTAAGGCCCCGCCCCCTAGCCTG CCCAGCCCCAGCCGGCTGCCCGGCCCCAGCGA CACCCCCATCCTGCCCCAGGGGGGCGGTGGA AGCGGCGGGGGCGGATCTGGGGGTGGGGGCT CTGGTGGGGAGGGAGTGGGGGGGGAGGCTC AGGGGGTGGTGGCTCTGGGGGCGGCGGCTCA CAGCTGTACAGCGCCCTGGCCAACAAGTGCTG CCACGTGGGCTGCACCAAGCGGAGCCTGGCC CGGTTCTGC | 5' UTR 1 | 3' UTR 1 | 238 |
| Construct 77 | ATGGGCGTGAAGGTGCTGTTCGCCCTGATCTG CATCGCCGTGGCCGAGGCCGACAGCTGGATG GAGGAGGTGATCAAGCTGTGCGGCCGGGAGC TGGTGCGGGCCCAGATCGCCATCTGCGGCATG AGCACCTGGAGCGGCGGAGGCGGAAGCGGCG GGGGGGGCAGTGGTGGAGGTGGTTCTGGTGG CGGGGGATCTGGAGGCGGCGGGTCAGGCGGT GGGGGCAGCGGAGGAGGGGGCTCTTTCCAGA GCTCCTCATCTAAGGCTCCTCCCCCAAGCCTG CCCAGCCCCAGCCGGCTGCCCGGCCCCAGCGA CACCCCCATCCTGCCCCAGGGAGGGGGAGGG AGTGGGGGCGGCGGCTCTGGGGGTGGAGGCT CAGGGGGCGGAGGAAGCGGAGGGGGTGGTAG CGGGGGCGGGGGTAGTGGGGGGGGTGGCTCC CAGCTGTACAGCGCCCTGGCCAACAAGTGCTG CCACGTGGGCTGCACCAAGCGGAGCCTGGCC CGGTTCTGC | 5' UTR 1 | 3' UTR 1 | 239 |
| Construct 78 | ATGGGCGTGAAAGTGCTGTTTGCGCTGATTTG CATTGCGGTGGCGGAAGCGGACTCATGGATG GAGGAAGTTATTAAATTATGCGGCCGCGAATT AGTTCGCGCGCAGATTGCCATTTGCGGCATGG AGCCCAAGAGCAGCGACAAGACCCACACCAG CCCCCCCAGCCCCGCCCCCGAGCTGCTGGGCG GCAGCAGCGTGTTCCTGTTCCCCCCCAAGCCC AAGGACACCCTCTACATCACCAGGGAGCCCG AGGTGACCTGCGTGGTGGTGGACGTGAGCCA CGAGGACCCCGAGGTGAAGTTCAACTGGTAC GTGGACGGCGTGGAGGTGCACAACGCCAAGA CCAAGCCCAGGGAGGAGCAGTACAACAGCAC CTACAGGGTGGTGAGCGTGCTGACCGTGCTGC ACCAGGACTGGCTGAACGGCAAGGAGTACAA | 5' UTR 1 | 3' UTR 1 | 240 |

TABLE 6-continued

DNA Sequences

| Name | ORF Sequence | 5' UTR | 3' UTR | SEQ ID NO: |
|---|---|---|---|---|
| | GTGCAAGGTGAGCAACAAGGCCCTGCCCGCC<br>CCCATCGAGAAGACCATCAGCAAGGCCAAGG<br>GCCAGCCCAGGGAGCCCCAGGTGTACACCCT<br>GCCCCCCAGCAGGGACGAGCTGACCAAGAAC<br>CAGGTGAGCCTGACCTGCCTGGTGAAGGGCTT<br>CTACCCCAGCGACATCGCCGTGGAGTGGGAG<br>AGCAACGGCCAGCCCGAGAACAACTACAAGA<br>CAACCCCCCCCGTGCTGGACAGCGACGGCAG<br>CTTCTTCCTGTACAGCAAGCTGACCGTGGACA<br>AGAGCAGGTGGCAGCAGGGCAACGTGTTCAG<br>CTGCAGCGTGATGCACGAGGCCCTGCACAACC<br>ACTACACCCAGAAGAGCCTGAGCCTGAGCCC<br>CGGCAAGAGGAAGAGCACCTGGAGCAAAAGG<br>TCTCTGAGCCAGGAAGATGCTCCTCAGACACC<br>TAGACCAGTGGCAGAAATTGTGCCATCCTTCA<br>TCAACAAAGATACAGAAACCATAAATATGAT<br>GTCAGAATTTGTTGCTAATTTGCCACAGGAGC<br>TGAAGTTAACCCTGTCTGAGATGCAGCCAGCA<br>TTACCACAGCTACAACAACATGTACCTGTATT<br>AAAAGATTCCAGTCTTCTCTTTGAAGAATTTA<br>AGAAACTTATTCGCAATAGACAAAGTGAAGC<br>CGCAGACAGCAGTCCTTCAGAATTAAAATACT<br>TAGGCTTGGATACTCATTCTCGAAAAAAGAGA<br>CAACTCTACAGTGCATTGGCTAATAAATGTTG<br>CCATGTTGGTTGTACCAAAAGATCTCTTGCTA<br>GATTTTGC | | | |
| Construct 79 | ATGCCCAGACTGTTCTTCTTCCACCTGCTGGG<br>CGTGTGCCTGTTACTTAACCAGTTCAGCAGAG<br>CCGTGGCCGACAGCTGGATGGAGGAGGTGAT<br>CAAGCTGTGCGGCAGAGAGCTGGTGAGAGCC<br>CAGATCGCCATCTGCGGCATGTCTACCTGGAG<br>CGAGCCCAAGAGCAGCGACAAGACCCACACC<br>AGCCCCCCCAGCCCCGCCCCCGAGCTGCTGGG<br>CGGCAGCAGCGTGTTCCTGTTCCCCCCCAAGC<br>CCAAGGACACCCTGTACATCACCAGAGAGCC<br>CGAGGTGACCTGCGTGGTGGTGGACGTGAGC<br>CACGAGGACCCCGAGGTGAAGTTCAACTGGT<br>ACGTGGACGGCGTGGAGGTGCACAACGCCAA<br>GACCAAGCCCAGAGAGGAGCAGTACAACAGC<br>ACCTACAGAGTGGTGAGCGTGCTGACCGTGCT<br>GCACCAGGACTGGCTGAACGGGAAGGAGTAC<br>AAGTGCAAGGTGAGCAACAAGGCCCTGCCCG<br>CCCCCATCGAGAAGACCATCAGCAAGGCCAA<br>GGGCCAGCCCAGAGAGCCCCAGGTGTACACC<br>CTGCCCCCCAGCCGAGACGAACTGACCAAGA<br>ATCAGGTGAGCCTGACCTGCCTGGTGAAGGGC<br>TTCTACCCCAGCGACATCGCCGTGGAGTGGGA<br>AAGCAACGGCCAGCCCGAGAACAACTACAAG<br>ACCACCCCCCCCGTGCTGGACAGCGACGGCA<br>GCTTCTTCCTGTATAGCAAGCTGACCGTGGAC<br>AAGTCAAGATGGCAGCAGGGCAACGTGTTCA<br>GCTGCAGCGTGATGCACGAGGCCCTGCACAA<br>CCACTACACCCAGAAGAGCCTGAGCCTGAGC<br>CCCGGCAAGAGAAAGAAGAGAAGCCTGAGCC<br>AGGAGGACGCCCCCCAGACACCTAGACCCGT<br>GGCCGAGATCGTGCCCAGCTTTATCAACAAGG<br>ACACCGAGACCATCAACATGATGTCCGAGTTC<br>GTGGCCAACCTGCCCCAGGAGCTGAAGCTGA<br>CCCTGAGCGAGATGCAGCCCGCCCTGCCCCAG<br>CTGCAGCAGCACGTGCCAGTGCTGAAGGACA<br>GCAGCCTGCTGTTCGAGGAGTTCAAGAAGCTG<br>ATCAGAAACAGACAGAGCGAGGCCGCCGACA<br>GCAGCCCCAGCGAGCTGAAGTACCTGGGCCT<br>GGACACCCACAGCAGAAAGAAGAGACAACTG<br>TACAGCGCCCTGGCCAATAAGTGCTGCCACGT<br>GGGCTGCACCAAGAGAAGCCTGGCCAGATTC<br>TGC | 5' UTR 1 | 3' UTR 2 | 241 |
| Construct 80 | ATGCCTAGGTTGTTTTTCTTTCACTTACTAGGA<br>GTATGTTTACTCCTGAATCAATTTTCTAGGGCT<br>GTCGCAGATAGTTGGATGGAGGAGGTAATCA<br>AATTATGTGGAAGAGAGTTAGTTCGTGCTCAA<br>ATAGCTATTTGTGGTATGTCAACTTGGAGCGG | 5' UTR 1 | 3' UTR 2 | 242 |

TABLE 6-continued

| Name | ORF Sequence | 5' UTR | 3' UTR | SEQ ID NO: |
|---|---|---|---|---|
| | AGGGGGCGGCTCGGGCGGAGGGGGAAGCGGA<br>GGGGGTGGCTCAGGAGGGGGCGGTTCTGGTG<br>GCGGCGGATCAGGTGGTGGAGGATCAGGAGG<br>CGGGGGGCAGCTTTCAGTCGTCGTCATCCAAAG<br>CGCCTCCACCCTCACTGCCCTCCCCCTCCAGA<br>TTACCTGGGCCCTCCGATACCCCCATTTTGCC<br>ACAAGGGGTGGAGGATCCGGGGGGGGAGGC<br>AGTGGTGGTGGTGGTAGCGGTGGTGGGGGCT<br>CCGGTGGAGGCGGAAGTGGTGGGGGAGGATC<br>CGGGGGGGGCGGATCGCAGCTCTATTCCGCTC<br>TTGCCAATAAATGTTGCCACGTCGGTTGTACA<br>AAACGGTCCCTGGCCAGATTCTGC | | | |
| Construct 81 | ATGCCCAGACTGTTCTTCTTCCACCTGCTGGG<br>CGTGTGCCTGTTACTTAACCAGTTCAGCAGAG<br>CCGTGGCCGACAGCTGGATGGAGGAGGTGAT<br>CAAGCTGTGCGGCAGAGAGCTGGTGAGAGCC<br>CAGATCGCCATCTGCGGCATGTCTACCTGGAG<br>CGAGCCCAAGAGCAGCGACAAGACCCACACC<br>AGCCCCCCCAGCCCCGCCCCCGAGCTGCTGGG<br>CGGCAGCAGCGTGTTCCTGTTCCCCCCCAAGC<br>CCAAGGACACCCTGTACATCACCAGAGAGCC<br>CGAGGTGACCTGCGTGGTGGTGGACGTGAGC<br>CACGAGGACCCCGAGGTGAAGTTCAACTGGT<br>ACGTGGACGGCGTGGAGGTGCACAACGCCAA<br>GACCAAGCCCAGAGAGGAGCAGTACAACAGC<br>ACCTACAGAGTGGTGAGCGTGCTGACCGTGCT<br>GCACCAGGACTGGCTGAACGGGAAGGAGTAC<br>AAGTGCAAGGTGAGCAACAAGGCCCTGCCCG<br>CCCCCATCGAGAAGACCATCAGCAAGGCCAA<br>GGGCCAGCCCAGAGAGCCCCAGGTGTACACC<br>CTGCCCCCCAGCCGAGACGAACTGACCAAGA<br>ATCAGGTGAGCCTGACCTGCCTGGTGAAGGGC<br>TTCTACCCCAGCGACATCGCCGTGGAGTGGGA<br>AAGCAACGGCCAGCCCGAGAACAACTACAAG<br>ACCACCCCCCCCGTGCTGGACAGCGACGGCA<br>GCTTCTTCCTGTATAGCAAGCTGACCGTGGAC<br>AAGTCAAGATGGCAGCAGGGCAACGTGTTCA<br>GCTGCAGCGTGATGCACGAGGCCCTGCACAA<br>CCACTACACCCAGAAGAGCCTGAGCCTGAGC<br>CCCGGCAAGAGAAAGAAGAGAAGCCTGAGCC<br>AGGAGGACGCCCCCCAGACACCTAGACCCGT<br>GGCCGAGATCGTGCCCAGCTTTATCAACAAGG<br>ACACCGAGACCATCAACATGATGTCCGAGTTC<br>GTGGCCAACCTGCCCCAGGAGCTGAAGCTGA<br>CCCTGAGCGAGATGCAGCCCGCCCTGCCCCAG<br>CTGCAGCAGCACGTGCCAGTGCTGAAGGACA<br>GCAGCCTGCTGTTCGAGGAGTTCAAGAAGCTG<br>ATCAGAAACAGACAGAGCGAGGCCGCCGACA<br>GCAGCCCCAGCGAGCTGAAGTACCTGGGCCT<br>GGACACCCACAGCAGAAAGAAGAGACAACTG<br>TACAGCGCCCTGGCCAATAAGTGCTGCCACGT<br>GGGCTGCACCAAGAGAAGCCTGGCCAGATTC<br>TGC | 5' UTR 1 | 3' UTR 1 | 243 |
| Construct 82 | ATGGGCGTGAAGGTGCTGTTCGCACTGATCTG<br>CATCGCCGTGGCCGAGGCCGACAGCTGGATG<br>GAGGAGGTGATCAAGCTGTGCGGCAGAGAGC<br>TGGTGAGAGCCCAGATCGCCATCTGCGGCATG<br>AGCACCTGGAGCGAGCCCAAGAGCAGCGACA<br>AGACCCACACCAGCCCCCCCAGCCCCGCTCCC<br>GAGCTGCTGGGCGGCAGCAGCGTGTTCCTGTT<br>CCCCCCCAAGCCCAAGGACACCCTGTACATAA<br>CCAGAGAGCCAGAGGTGACCTGCGTGGTGGT<br>GGACGTGAGCCACGAGGACCCCGAGGTGAAG<br>TTCAACTGGTACGTGGACGGCGTGGAGGTGCA<br>CAACGCCAAGACAAAGCCCAGAGAGGAGCAG<br>TACAACAGCACCTACAGAGTGGTGAGCGTGCT<br>GACCGTGCTGCACCAGGACTGGCTGAACGGC<br>AAGGAGTATAAGTGCAAGGTGAGCAACAAGG<br>CCCTGCCCGCCCCCATCGAGAAGACCATCAGC<br>AAGGCCAAGGGCCAGCCCAGAGAGCCCCAGG<br>TGTACACCCTGCCCCCCAGCAGAGACGAGCTG<br>ACCAAGAACCAGGTGAGCCTGACCTGCCTGGT | 5' UTR 1 | 3' UTR 2 | 244 |

TABLE 6-continued

DNA Sequences

| Name | ORF Sequence | 5' UTR | 3' UTR | SEQ ID NO: |
|---|---|---|---|---|
| | GAAGGGCTTCTACCCCAGCGACATCGCCGTGG AGTGGGAGAGCAACGGCCAGCCCGAGAACAA CTACAAGACCACCCCCCCCGTGCTGGACAGCG ACGGCAGCTTCTTCCTGTACAGCAAGCTGACC GTGGACAAGAGCAGATGGCAGCAGGGCAACG TGTTCAGCTGCAGCGTGATGCACGAGGCCTTA CACAACCACTACACCCAGAAGAGCCTAAGCC TGAGCCCCGGCAAGAGAAAGAAGAGAAGTCT GAGCCAGGAGGACGCCCCCCAGACCCCCAGA CCCGTGGCCGAGATCGTGCCCTCCTTCATTAA CAAGGACACCGAGACCATCAACATGATGAGC GAGTTCGTGGCCAACCTGCCCCAGGAGCTGAA GCTGACCCTGAGCGAAATGCAACCCGCCCTGC CCCAGCTGCAACAGCACGTGCCCGTGCTGAAG GACAGCAGCCTGCTGTTCGAGGAGTTCAAAA AGCTGATCAGAAACAGACAGAGCGAGGCCGC CGACTCCAGCCCCAGCGAGCTGAAGTACCTGG GCCTGGACACCCACAGCAGAAAGAAGAGACA GCTGTACAGCGCCCTGGCCAACAAGTGCTGCC ACGTGGGCTGCACCAAGAGAAGCCTGGCCAG ATTCTGC | | | |
| Construct 83 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCGA GCCCAAGAGCAGCGACAAGACCCACACCAGC CCCCCCAGCCCCGCCCCCGAGCTGCTGGGCGG CAGCAGCGTGTTCCTGTTCCCCCCCAAGCCCA AGGACACCCTGTACATCACCAGGGAGCCCGA GGTGACCTGCGTGGTGGTGGACGTGAGCCAC GAGGACCCCGAGGTGAAGTTCAACTGGTACG TGGACGGCGTGGAGGTGCACAACGCCAAGAC CAAGCCCAGGGAGGAGCAGTACAACAGCACC TACAGGGTGGTGAGCGTGCTGACCGTGCTGCA CCAGGACTGGCTGAACGGCAAGGAGTACAAG TGCAAGGTGAGCAACAAGGCCCTGCCCGCCC CCATCGAGAAGACCATCAGCAAGGCCAAGGG CCAGCCCAGGGAGCCCCAGGTGTACACCCTGC CCCCCAGCAGGGACGAGCTGACCAAGAACCA GGTGAGCCTGACCTGCCTGGTGAAGGGCTTCT ACCCCAGCGACATCGCCGTGGAGTGGGAGAG CAACGGCCAGCCCGAGAACAACTACAAGACC ACCCCCCCCGTGCTGGACAGCGACGGCAGCTT CTTCCTGTACAGCAAGCTGACCGTGGACAAGA GCAGGTGGCAGCAGGGCAACGTGTTCAGCTG CAGCGTGATGCACGAGGCCCTGCACAACCACT ACACCCAGAAGAGCCTGAGCCTGAGCCCCGG CAAGAGGAAGAAAGGTCTCTGAGCCAGGAA GATGCTCCTCAGACACCTAGACCAGTGGCAGA AATTGTGCCATCCTTCATCAACAAAGATACAG AAACCATAAATATGATGTCAGAATTTGTTGCT AATTTGCCACAGGAGCTGAAGTTAACCCTGTC TGAGATGCAGCCAGCATTACCACAGCTACAAC AACATGTACCTGTATTAAAAGATTCCAGTCTT CTCTTTGAAGAATTTAAGAAACTTATTCGCAA TAGACAAAGTGAAGCCGCAGACAGCAGTCCT TCAGAATTAAAATACTTAGGCTTGGATACTCA TTCTCGAAAAAAGAGACAACTCTACAGTGCAT TGGCTAATAAATGTTGCCATGTTGGTTGTACC AAAAGATCTCTTGCTAGATTTTGC | 5' UTR 1 | 3' UTR 2 | 245 |
| Construct 84 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCGA GCCCAAGAGCAGCGACAAGACCCACACCAGC CCCCCCAGCCCCGCCCCCGAGCTGCTGGGCGG CAGCAGCGTGTTCCTGTTCCCCCCCAAGCCCA AGGACACCCTGTACATCACCAGGGAGCCCGA GGTGACCTGCGTGGTGGTGGACGTGAGCCAC GAGGACCCCGAGGTGAAGTTCAACTGGTACG | 5' UTR 1 | 3' UTR 1 | 246 |

TABLE 6-continued

DNA Sequences

| Name | ORF Sequence | 5' UTR | 3' UTR | SEQ ID NO: |
|---|---|---|---|---|
| | TGGACGGCGTGGAGGTGCACAACGCCAAGAC<br>CAAGCCCAGGGAGGAGCAGTACAACAGCACC<br>TACAGGGTGGTGAGCGTGCTGACCGTGCTGCA<br>CCAGGACTGGCTGAACGGCAAGGAGTACAAG<br>TGCAAGGTGAGCAACAAGGCCCTGCCCGCCC<br>CCATCGAGAAGACCATCAGCAAGGCCAAGGG<br>CCAGCCCAGGGAGCCCCAGGTGTACACCCTGC<br>CCCCCAGCAGGGACGAGCTGACCAAGAACCA<br>GGTGAGCCTGACCTGCCTGGTGAAGGGCTTCT<br>ACCCCAGCGACATCGCCGTGGAGTGGGAGAG<br>CAACGGCCAGCCCGAGAACAACTACAAGACC<br>ACCCCCCCCGTGCTGGACAGCGACGGCAGCTT<br>CTTCCTGTACAGCAAGCTGACCGTGGACAAGA<br>GCAGGTGGCAGCAGGGCAACGTGTTCAGCTG<br>CAGCGTGATGCACGAGGCCCTGCACAACCACT<br>ACACCCAGAAGAGCCTGAGCCTGAGCCCCGG<br>CAAGAGGAAGAAAAGGTCTCTGAGCCAGGAA<br>GATGCTCCTCAGACACCTAGACCAGTGGCAGA<br>AATTGTGCCATCCTTCATCAACAAAGATACAG<br>AAACCATAAATATGATGTCAGAATTTGTTGCT<br>AATTTGCCACAGGAGCTGAAGTTAACCCTGTC<br>TGAGATGCAGCCAGCATTACCACAGCTACAAC<br>AACATGTACCTGTATTAAAAGATTCCAGTCTT<br>CTCTTTGAAGAATTTAAGAAACTTATTCGCAA<br>TAGACAAAGTGAAGCCGCAGACAGCAGTCCT<br>TCAGAATTAAAATACTTAGGCTTGGATACTCA<br>TTCTCGAAAAAAGAGACAACTCTACAGTGCAT<br>TGGCTAATAAATGTTGCCATGTTGGTTGTACC<br>AAAAGATCTCTTGCTAGATTTTGC | | | |
| Construct 85 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCGA<br>GGTGCAGCTGCTGGAGAGCGGCGGCGGCCTG<br>GTGCAGCCCGGCGGCAGCCTGAGGCTGAGCT<br>GCGTGGCCAGCGGCTTCACCTTCAACAGCAGC<br>GCCATGAGCTGGGTGAGGCAGGCCCCCGGCA<br>AGGGCCTGGAGTGGGTGAGCGCCATCAGCGG<br>CAGCGGCGACAGGACCTACTACGCCGACAGC<br>GTGAAGGGCAGGTTCACCATCAGCAGGGACA<br>ACAGCAAGAACACCCTGTACCTGCAGATGAA<br>CAGCCTGAGGGCCGAGGACACCGCCGTGTAC<br>TACTGCACCACCGACCCCCCCAGGTACCACTA<br>CAACGGCCTGGCCGTGAGGGGCCAGGGCACC<br>ACCGTGACCGTGAGCAGCAAAAGGTCTCTGA<br>GCCAGGAAGATGCTCCTCAGACACCTAGACC<br>AGTGGCAGAAATTGTGCCATCCTTCATCAACA<br>AAGATACAGAAACCATAAATATGATGTCAGA<br>ATTTGTTGCTAATTTGCCACAGGAGCTGAAGT<br>TAACCCTGTCTGAGATGCAGCCAGCATTACCA<br>CAGCTACAACAACATGTACCTGTATTAAAAGA<br>TTCCAGTCTTCTCTTTGAAGAATTTAAGAAAC<br>TTATTCGCAATAGACAAAGTGAAGCCGCAGA<br>CAGCAGTCCTTCAGAATTAAAATACTTAGGCT<br>TGGATACTCATTCTCGAAAAAAGAGACAACTC<br>TACAGTGCATTGGCTAATAAATGTTGCCATGT<br>TGGTTGTACCAAAAGATCTCTTGCTAGATTTT<br>GC | 5' UTR 1 | 3' UTR 2 | 247 |
| Construct 86 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCGA<br>GGTGCAGCTGCTGGAGAGCGGCGGCGGCCTG<br>GTGCAGCCCGGCGGCAGCCTGAGGCTGAGCT<br>GCGCCGCCAGCGGCTTCACCTTCAGCAGCTAC<br>GCCATGAGCTGGGTGAGGCAGGCCCCCGGCA<br>AGGGCCTGGAGTGGGTGAGCGCCATCAGCGG<br>CAGCGGCGGCAGCACCTACTACGCCGACAGC<br>GTGAAGGGCAGGTTCACCATCAGCAGGGACA<br>ACAGCAAGAACACCCTGTACCTGCAGATGAA | 5' UTR 1 | 3' UTR 2 | 248 |

TABLE 6-continued

DNA Sequences

| Name | ORF Sequence | 5' UTR | 3' UTR | SEQ ID NO: |
|---|---|---|---|---|
| | CAGCCTGAGGGCCGAGGACACCGCCGTGTAC<br>TACTGCACCAAGGACCCCCCCAGGTACCACTA<br>CACCGGCCTGGCCGTGAGGGGCCAGGGCACC<br>ACCGTGACCGTGAGCAGCAAAAGGTCTCTGA<br>GCCAGGAAGATGCTCCTCAGACACCTAGACC<br>AGTGGCAGAAATTGTGCCATCCTTCATCAACA<br>AAGATACAGAAACCATAAATATGATGTCAGA<br>ATTTGTTGCTAATTTGCCACAGGAGCTGAAGT<br>TAACCCTGTCTGAGATGCAGCCAGCATTACCA<br>CAGCTACAACAACATGTACCTGTATTAAAAGA<br>TTCCAGTCTTCTCTTTGAAGAATTTAAGAAAC<br>TTATTCGCAATAGACAAAGTGAAGCCGCAGA<br>CAGCAGTCCTTCAGAATTAAAATACTTAGGCT<br>TGGATACTCATTCTCGAAAAAAGAGACAACTC<br>TACAGTGCATTGGCTAATAAATGTTGCCATGT<br>TGGTTGTACCAAAAGATCTCTTGCTAGATTTT<br>GC | | | |
| Construct 87 | ATGCCTCGCCTGTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGTCCGG<br>GTCGACCGATAGCGGTTCCGACACTTCCTCCG<br>GAAACTCCGGGGACGGCAACAGCGGCTTCCA<br>GTCGAGCTCCTCAAAGGCCCCACCTCCCTCAC<br>TGCCCTCCCCTTCTCGGCTCCCTGGACCGTCCG<br>ATACTCCGATCCTGCCGCAATTCCAGTCCAGC<br>AGCTCCAAGGCCCCTCCACCGTCACTGCCATC<br>CCCGTCGAGGTTGCCGGGACCCTCAGACACGC<br>CCATCCTGCCTCAGGGCAGCACCGACTCGGGA<br>TCCGATACCTCGTCCGGGAACTCCGGCGACGG<br>GAACTCGGGACAACTCTACAGTGCATTGGCTA<br>ATAAATGTTGCCATGTTGGTTGTACCAAAAGA<br>TCTCTTGCTAGATTTTGC | 5' UTR 1 | 3' UTR 2 | 249 |
| Construct 88 | ATGCCTCGCCTGTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGTCCGG<br>AGGAGGAGGGTCCTTCCAGTCAAGCAGCTCC<br>AAGGCCCCTCCACCAAGCCTCCCTAGCCCGTC<br>CAGGCTTCCGGGACCGTCGGATACTCCCATCC<br>TGCCCCAGTTCCAGTCCTCGTCGTCCAAGGCT<br>CCCCCTCCATCCCTGCCCTCACCCTCACGGCT<br>GCCAGGACCGTCCGACACCCCTATCCTGCCGC<br>AAGGCGGTGGAGGGTCACAACTCTACAGTGC<br>ATTGGCTAATAAATGTTGCCATGTTGGTTGTA<br>CCAAAAGATCTCTTGCTAGATTTTGC | 5' UTR 1 | 3' UTR 2 | 250 |
| Construct 89 | ATGCCGAGACTGTTCTTCTTCCACCTCCTCGGC<br>GTGTGCCTCCTCCTCAACCAGTTCTCTCGAGC<br>CGTGGCGGATAGCTGGATGGAGGAGGTGATC<br>AAGCTCTGTGGCCGTGAGCTCGTCCGGGCCCA<br>GATCGCCATCTGCGGCATGTCCACCTGGTCCG<br>AGCCCAAGTCCTCCGACAAGACCCACACCTCG<br>CCCCCCAGCCCTGCCCCCGAGCTCCTGGGCGG<br>CAGCTCCGTCTTCCTGTTCCCGCCCAAGCCGA<br>AGGATACCCTGTACATCACCAGGGAGCCCGA<br>GGTGACCTGTGTCGTGGTGGACGTGAGCCACG<br>AGGACCCCGAGGTGAAGTTTAATTGGTACGTC<br>GACGGCGTGGAGGTGCACAACGCCAAGACCA<br>AGCCCAGGGAGGAGCAGTACAACTCCACCTA<br>CCGGGTGGTGAGCGTGCTGACAGTCCTGCATC<br>AGGACTGGCTGAACGGCAAGGAATACAAGTG<br>CAAGGTGAGCAACAAGGCCCTGCCCGCCCCC<br>ATCGAGAAGACCATCAGCAAGGCCAAGGGCC<br>AACCCCGGGAACCCCAGGTCTACACCCTGCCT<br>CCCAGCAGGGATGAGCTGACCAAGAACCAGG<br>TTAGCCTGACCTGCCTGGTCAAGGGCTTCTAC<br>CCCTCCGACATTGCCGTGGAGTGGGAGAGCA<br>ACGGTCAGCCCGAGAACAACTACAAGACCAC<br>CCCTCCCGTGCTCGACAGCGACGGTTCCTTCT | 5' UTR 1 | 3' UTR 1 | 251 |

TABLE 6-continued

DNA Sequences

| Name | ORF Sequence | 5' UTR | 3' UTR | SEQ ID NO: |
|---|---|---|---|---|
| | TCCTGTACAGCAAGCTGACGGTGGACAAGAG<br>CCGCTGGCAGCAGGGCAACGTGTTCAGCTGCT<br>CCGTGATGCACGAAGCCCTGCACAACCACTAC<br>ACCCAGAAGTCCCTGAGCCTGTCACCCGGCAA<br>GAGGAAGAAGCGGAGCCTGTCCCAGGAGGAT<br>GCCCCCCAGACCCCTAGACCTGTGGCCGAAAT<br>TGTGCCCTCCTTTATCAACAAGGACACCGAAA<br>CCATCAATATGATGTCCGAGTTCGTGCCCAAC<br>CTGCCCCAGGAGCTGAAACTCACCCTGAGCGA<br>GATGCAGCCCGCCCTGCCCCAGCTGCAACAGC<br>ACGTGCCCGTGCTGAAGGACTCATCTCTGCTG<br>TTCGAGGAATTCAAGAAGCTGATCAGGAACA<br>GGCAGAGCGAGGCCGCCGACAGCAGTCCCAG<br>CGAGCTGAAATACCTGGGCCTGGACACCCACT<br>CCCGCAAGAAGCGGCAGCTGTACAGCGCCCT<br>GGCCAACAAGTGCTGCCACGTAGGCTGCACC<br>AAACGCAGCCTGGCACGGTTCTGC | | | |
| Construct 90 | ATGCCCCGTCTCTTCTTCTTCCACCTCCTCGGA<br>GTGTGCCTCCTCCTCAACCAGTTCAGCAGGGC<br>CGTGGCCGACTCCTGGATGGAGGAAGTGATC<br>AAGCTCTGCGGCAGGGAGCTCGTGAGGGCCC<br>AAATCGCCATCTGCGGCATGAGCACCTGGTCC<br>GAGCCCAAGAGCTCCGACAAGACTCACACCA<br>GCCCCCCGAGCCCCGCCCCCGAGCTGCTGGGC<br>GGGAGCAGCGTGTTTCTGTTCCCTCCCAAGCC<br>CAAGGACACCCTGTACATCACCCGCGAGCCG<br>GAAGTGACCTGCGTGGTGGTGGACGTCTCCCA<br>CGAGGACCCCGAGGTGAAATTCAACTGGTAC<br>GTGGACGGCGTGGAAGTGCACAATGCGAAGA<br>CCAAGCCCAGGGAGGAGCAGTACAACAGCAC<br>CTACAGGGTAGTCAGCGTGCTGACCGTGCTGC<br>ATCAGGACTGGCTGAATGGCAAGGAGTACAA<br>GTGCAAAGTGTCCAATAAGGCTCTGCCCGCCC<br>CCATCGAGAAGACCATCAGCAAAGCCAAGGG<br>ACAGCCCAGAGAGCCCCAGGTGTACACCCTG<br>CCCCCGAGCAGGGACGAGCTGACCAAGAACC<br>AGGTCAGCCTGACCTGCCTGGTGAAGGGGTTT<br>TACCCCAGCGACATCGCCGTGGAGTGGGAGA<br>GCAACGGCCAGCCCGAGAACAACTACAAGAC<br>GACACCCCCGGTGCTGGACAGCGACGGGTCTT<br>TCTTCCTGTACAGCAAGCTGACCGTGGATAAA<br>TCCAGATGGCAGCAGGGCAACGTCTTCAGCTG<br>CTCCGTGATGCATGAGGCCCTGCACAACCACT<br>ACACGCAGAAGTCACTGTCCCTGAGCCCCGGC<br>AAGAGGAAGAAGCGGAGCCTGAGCCAGGAGG<br>ACGCCCCCAGACCCCCCGGCCCGTGGCGGA<br>GATCGTGCCTAGCTTCATCAACAAGGACACCG<br>AGACTATCAACATGATGAGCGAGTTCGTGGCC<br>AACCTGCCCCAGGAGCTGAAGCTCACCCTGTC<br>CGAAATGCAGCCGGCCCTCCCGCAGCTGCAGC<br>AGCACGTACCCGTGCTGAAAGATTCCAGTCTG<br>CTGTTTGAGGAGTTCAAGAAGCTGATCAGGAA<br>TCGGCAGTCCGAGGCCGCCGACAGCAGCCCG<br>TCCGAGTTGAAGTACCTCGGCCTGGATACCCA<br>TTCGCGGAAGAAGAGGCAACTGTACTCCGCCC<br>TGGCCAACAAGTGCTGTCACGTGGGGTGCACA<br>AAGAGAAGCCTGGCCCGTTTCTGC | 5' UTR 1 | 3' UTR 1 | 252 |
| Construct 91 | ATGCCCAGGCTGTTCTTCTTCCACCTCCTCGGC<br>GTGTGTCTCCTCCTCAACCAATTTAGCCGTGC<br>CGTGGCGGACAGCTGGATGGAGGAGGTGATC<br>AAGCTCTGTGGTAGAGAGCTCGTCCGTGCCCA<br>GATTGCCATCTGTGGCATGTCCACCTGGAGCG<br>AGCCCAAGTCCAGCGACAAGACCCACACCAG<br>CCCGCCCAGCCCTGCCCCCGAGCTGCTGGGCG<br>GCAGCAGCGTGTTCCTGTTCCCGCCCAAGCCC<br>AAGGACACACTGTACATAACCCGGGAGCCCG<br>AGGTGACCTGTGTGGTGGTCGACGTCAGCCAC<br>GAGGACCCCGAGGTCAAATTCAACTGGTACGT<br>GGACGGCGTGGAGGTGCACAACGCCAAGACT<br>AAACCCCGGGAGGAACAATACAACTCCACCT<br>ACAGGGTGGTATCCGTGCTGACCGTCCTGCAC<br>CAGGATTGGCTCAACGGCAAAGAGTATAAGT | 5' UTR 1 | 3' UTR 1 | 253 |

TABLE 6-continued

DNA Sequences

| Name | ORF Sequence | 5' UTR | 3' UTR | SEQ ID NO: |
|---|---|---|---|---|
| | GCAAAGTGTCCAACAAGGCCCTGCCCGCCCCC<br>ATCGAGAAGACGATCAGCAAGGCCAAGGGCC<br>AGCCCCGGGAGCCCCAGGTCTACACGCTGCCC<br>CCCAGCAGAGACGAGCTTACCAAGAACCAGG<br>TTTCCCTGACCTGCCTGGTGAAGGGCTTCTAC<br>CCGAGCGACATTGCCGTGGAGTGGGAGAGCA<br>ACGGCCAGCCCGAGAATAACTACAAGACCAC<br>GCCCCCCGTGCTCGACTCCGACGGCAGCTTCT<br>TTCTCTACTCCAAGCTGACCGTTGACAAGAGC<br>CGCTGGCAGCAGGGAAACGTGTTCAGCTGCA<br>GCGTCATGCACGAGGCCCTGCACAACCACTAC<br>ACGCAGAAGTCCCTGAGCCTGTCCCCCGGCAA<br>ACGTAAGAAGAGGAGCCTGAGCCAGGAGGAC<br>GCCCCCCAGACCCCCAGGCCAGTGGCCGAGA<br>TCGTCCCCTCCTTCATAAACAAGGACACCGAA<br>ACCATCAACATGATGAGCGAGTTCGTGGCCAA<br>CCTGCCCCAGGAGCTGAAGCTGACCCTCAGCG<br>AGATGCAGCCCGCCCTCCCCCAACTCCAGCAG<br>CACGTGCCCGTGCTCAAGGACAGCAGCCTGCT<br>GTTTGAGGAGTTCAAGAAACTGATCCGCAACA<br>GACAGAGCGAGGCCGCCGACAGCAGCCCCAG<br>CGAGCTCAAGTACCTGGGTCTGGACACCCATA<br>GCAGGAAGAAGAGGCAGCTGTACAGTGCCCT<br>GGCGAACAAGTGCTGCCACGTGGGCTGCACC<br>AAGAGGAGCCTTGCCAGGTTCTGC | | | |
| Construct 92 | ATGCCGAGACTTTTCTTCTTCCACTTGCTCGGC<br>GTGTGCCTCCTCCTTAACCAATTTAGCAGAGC<br>CGTGGCAGACTCCTGGATGGAGGAGGTGATC<br>AAGCTCTGCGGCAGGGAGCTCGTGAGGGCGC<br>AGATCGCCATTTGCGGTATGTCCACATGGAGC<br>GAGCCCAAGAGCTCAGATAAGACCCACACCA<br>GCCCTCCCAGCCCCGCCCCCGAGCTGCTGGGC<br>GGCAGCAGCGTGTTCCTCTTCCCGCCCAAACC<br>CAAGGACACCCTGTACATCACCAGGGAGCCC<br>GAGGTGACCTGCGTGGTCGTCGACGTATCCCA<br>CGAGGACCCCGAGGTGAAGTTCAACTGGTAC<br>GTGGACGGGGTGGAGGTGCATAACGCCAAGA<br>CCAAGCCCCGGGAGGAGCAGTACAACAGCAC<br>CTACCGGGTGGTGTCCGTGCTGACAGTCCTGC<br>ACCAGGACTGGCTGAACGGCAAGGAGTACAA<br>GTGCAAGGTCAGCAACAAAGCCCTGCCCGCC<br>CCCATCGAGAAGACCATCTCAAAGGCCAAGG<br>GCCAGCCCCGCGAGCCACAGGTGTATACGCT<br>GCCGCCCAGCAGAGACGAGCTGACCAAGAAC<br>CAGGTGAGCCTGACCTGCCTGGTCAAGGGCTT<br>CTATCCCAGCGACATCGCCGTTGAGTGGGAGA<br>GCAACGGCCAGCCCGAGAACAACTATAAGAC<br>CACTCCACCCGTCCTGGACAGCGATGGGAGCT<br>TCTTCCTGTACTCCAAGCTGACCGTGGACAAG<br>AGCCGCTGGCAGCAGGGCAATGTGTTCAGCTG<br>CTCCGTGATGCACGAGGCCCTGCATAACCATT<br>ACACCCAGAAGTCGCTGAGCCTGAGCCCTGGC<br>AAGAGGAAGAAACGCAGCCTGAGCCAGGAGG<br>ATGCCCCGCAGACCCCTCGGCCGGTGGCCGAG<br>ATCGTGCCTTCCTTCATCAACAAGGACACCGA<br>GACAATCAACATGATGTCCGAGTTCGTAGCCA<br>ATCTGCCCCAGGAGCTGAAGCTGACCCTCTCC<br>GAGATGCAGCCCGCCCTGCCCCAGCTGCAGCA<br>ACACGTCCCGGTGCTCAAGGACAGCAGCCTGC<br>TGTTCGAGGAGTTTAAGAAGCTGATCCGCAAC<br>AGGCAGTCCGAGGCCGCCGATAGCAGCCCCA<br>GCGAGCTGAAGTACCTGGGCCTCGACACACAT<br>AGCAGGAAGAAGCGGCAGCTCTACTCCGCCC<br>TCGCCAATAAGTGCTGTCACGTGGGCTGCACC<br>AAGAGAAGCCTGGCCAGATTTTGC | 5' UTR 1 | 3' UTR 1 | 254 |
| Construct 93 | ATGCCCCGGCTGTTCTTCTTCCACCTCCTCGGC<br>GTGTGCCTCCTCCTCAATCAGTTCTCCAGGGC<br>CGTCGCCGACTCCTGGATGGAGGAGGTGATCA<br>AGCTCTGCGGGCGCGAGCTCGTGAGAGCCCA<br>GATTGCCATCTGCGGCATGTCCACCTGGAGCG<br>AGCCCAAGAGCAGCGACAAGACCCACACCTC<br>CCCTCCCAGCCCCGCGCCGGAGCTGCTGGGCG | 5' UTR 1 | 3' UTR 1 | 255 |

TABLE 6-continued

DNA Sequences

| Name | ORF Sequence | 5' UTR | 3' UTR | SEQ ID NO: |
|---|---|---|---|---|
| | GCAGCAGCGTGTTTCTGTTCCCTCCCAAGCCC<br>AAGGACACCCTGTACATCACTAGGGAGCCCG<br>AGGTGACCTGCGTGGTCGTGGATGTGAGCCAC<br>GAAGATCCAGAGGTGAAGTTCAATTGGTACGT<br>CGACGGCGTGGAGGTGCACAATGCCAAGACC<br>AAGCCCAGGGAGGAGCAGTACAACAGCACCT<br>ACAGGGTCGTTTCCGTGCTCACCGTGCTGCAC<br>CAGGACTGGCTGAACGGCAAGGAGTACAAGT<br>GCAAGGTCAGCAACAAAGCCCTACCCGCCCC<br>CATCGAGAAGACAATCAGCAAAGCCAAGGGC<br>CAGCCCAGGGAGCCCCAGGTGTATACCCTCCC<br>ACCCTCCAGGGACGAACTGACCAAGAATCAG<br>GTCAGCCTGACCTGCCTTGTCAAGGGCTTTTA<br>CCCCAGCGACATCGCCGTGGAGTGGGAGAGC<br>AACGGCCAACCCGAGAACAATTACAAGACCA<br>CCCCCGCCCGTCCTGGACTCCGACGGGTCCTTC<br>TTCCTATACAGCAAGCTGACCGTGGACAAGTC<br>CAGATGGCAGCAAGGGAACGTGTTCTCCTGCT<br>CCGTGATGCACGAGGCCCTGCACAATCACTAC<br>ACGCAGAAGAGTCTGAGCCTGAGCCCCGGGA<br>AGCGGAAGAAGCGATCCCTGAGCCAGGAGGA<br>CGCCCCGCAGACACCCCGCCCCGTGGCCGAG<br>ATTGTGCCCAGCTTCATCAACAAGGACACCGA<br>GACGATCAATATGATGTCCGAGTTCGTGGCCA<br>ACCTGCCACAGGAACTGAAGCTGACCCTGAG<br>CGAAATGCAGCCTGCGCTTCCGCAGCTGCAAC<br>AACATGTCCCCGTGCTGAAGGACAGCAGCCTG<br>CTGTTTGAGGAGTTCAAGAAGCTGATAAGGA<br>ACCGGCAGAGCGAGGCCGCCGACAGCAGCCC<br>CAGCGAACTGAAGTACCTGGGCCTGGACACC<br>CACAGCAGAAAGAAGAGGCAACTGTATAGCG<br>CACTGGCTAATAAGTGCTGTCACGTGGGCTGC<br>ACCAAACGCAGCCTGGCCAGGTTCTGC | | | |
| Construct 94 | ATGCCCAGACTGTTCTTCTTCCACCTCCTCGGG<br>GTGTGCCTCCTCCTCAACCAGTTCTCCAGGGC<br>CGTGGCCGACAGCTGGATGGAGGAGGTGATC<br>AAGCTCTGCGGCAGAGAGCTCGTCAGGGCCC<br>AGATCGCCATCTGCGGTATGAGCACGTGGAGC<br>GAGCCCAAGAGCTCCGACAAGACCCATACAA<br>GCCCCCGAGCCCCGCGCCCGAACTCCTGGGG<br>GGCTCCAGCGTGTTTCTGTTCCCGCCCAAGCC<br>CAAAGACACCCTGTACATCACCCGGGAGCCTG<br>AGGTGACCTGCGTGGTGGTGGACGTGTCCCAC<br>GAAGACCCTGAGGTGAAATTCAACTGGTACGT<br>GGACGGCGTGGAGGTGCATAACGCCAAGACC<br>AAACCGCGTGAGGAGCAATACAACAGCACCT<br>ACCGGGTGGTGTCGGTGCTGACCGTCCTGCAC<br>CAGGACTGGCTGAACGGCAAGGAGTACAAGT<br>GTAAGGTGTCCAACAAGGCTCTCCCCGCCCCC<br>ATCGAGAAGACCATCTCCAAGGCCAAGGGCC<br>AGCCCCGCGAGCCCCAGGTGTACACCCTCCCG<br>CCCAGCCGCGACGAGCTGACCAAGAACCAGG<br>TGTCCCTGACCTGCTTGGTGAAGGGCTTCTAC<br>CCCAGCGACATCGCCGTGGAATGGGAGTCCA<br>ACGGCCAGCCGGAGAACAACTACAAGACCAC<br>TCCCCCCGTCCTGGACAGCGACGGCTCCTTCT<br>TCCTGTACAGCAAGCTGACCGTCGACAAGTCC<br>CGCTGGCAGCAGGGGAACGTGTTCTCCTGCAG<br>CGTGATGCACGAGGCCCTGCACAACCACTACA<br>CTCAGAAGTCTCTGTCCCTTAGCCCCGGCAAG<br>CGGAAGAAGAGGAGCCTGAGCCAGGAGGACG<br>CCCCCCAAACGCCTCGCCCCGTGGCCGAGATT<br>GTGCCCAGCTTCATCAACAAGGACACCGAAA<br>CCATCAATATGATGTCCGAGTTCGTGGCCAAC<br>CTGCCCCAGGAGCTGAAGCTGACCCTGTCCGA<br>GATGCAGCCCGCCCTGCCCCAGCTGCAGCAGC<br>ACGTGCCCGTGCTGAAGGACAGCAGCCTGCTG<br>TTCGAGGAGTTTAAGAAGCTGATCAGAAACA<br>GACAATCCGAGGCAGCCGACTCCTCCCCCAGC<br>GAGCTGAAATACCTGGGCCTGGACACCCATTC<br>CCGGAAGAAGCGGCAGCTGTACAGCGCCCTC<br>GCCAACAAGTGCTGCCACGTGGGCTGCACCA<br>AGAGAAGCCTGGCCAGGTTCTGC | 5' UTR 1 | 3' UTR 1 | 256 |

TABLE 6-continued

DNA Sequences

| Name | ORF Sequence | 5' UTR | 3' UTR | SEQ ID NO: |
|---|---|---|---|---|
| Construct 95 | ATGCCCCGCCTGTTCTTCTTCCACCTCCTCGGC GTGTGTCTCCTCCTTAACCAGTTCTCCCGTGCC GTGGCCGATAGCTGGATGGAGGAGGTGATCA AGCTCTGCGGCCGAGAGCTCGTGAGGGCACA GATCGCCATCTGTGGCATGTCCACCTGGAGCG AACCCAAGAGCTCCGATAAGACCCACACCAG CCCCCCTTCTCCCGCCCCCGAGCTGCTCGGCG GCAGCTCGGTGTTCCTGTTCCCACCCAAACCC AAGGACACCCTCTACATCACCAGAGAGCCCG AGGTAACCTGTGTGGTCGTGGATGTGTCCCAC GAGGACCCCGAGGTGAAGTTCAACTGGTACG TGGACGGGGTGGAGGTGCACAACGCCAAGAC CAAGCCCCGCGAGGAGCAGTACAACAGCACC TACCGCGTGGTGAGCGTGCTGACAGTGCTGCA CCAGGATTGGCTGAACGGCAAGGAGTACAAG TGCAAGGTGAGCAATAAGGCCCTGCCCGCCCC CATCGAGAAGACCATCAGCAAGGCCAAAGGG CAGCCCAGAGAACCCCAGGTGTACACCCTGCC CCCCAGCCGGGACGAGCTGACCAAGAACCAA GTGAGCCTCACCTGCCTGGTGAAGGGGTTCTA CCCCAGCGACATCGCCGTGGAGTGGGAGAGC AACGGCCAGCCCGAGAACAACTACAAGACCA CGCCTCCCGTGCTGGACTCCGACGGGAGCTTC TTCCTGTACAGCAAGCTGACCGTGGACAAGAG CCGCTGGCAACAGGGGAACGTGTTTAGCTGTA GCGTCATGCACGAGGCCCTGCACAATCACTAC ACCCAGAAGTCCCTGAGCCTGTCCCCGGCAA GAGGAAGAAGCGTTCCCTGAGCCAGGAGGAC GCCCCCCAGACACCCAGGCCGGTCGCAGAGA TCGTGCCCTCCTTCATCAACAAGGACACCGAG ACAATCAACATGATGAGCGAGTTCGTGGCCA ACCTGCCCCAGGAACTGAAGCTCACCCTGTCC GAGATGCAGCCCGCCCTGCCCCAGCTACAGCA GCACGTACCCGTGCTGAAGGACAGCAGCCTG CTGTTCGAGGAGTTCAAGAAGCTGATAAGGA ATCGCCAGTCCGAGGCCGCCGACTCATCCCCT AGCGAGCTGAAGTACCTCGGTCTGGACACCCA CAGCCGTAAGAAGAGGCAGCTGTATTCCGCCC TGGCCAACAAATGCTGCCATGTGGGCTGCACC AAGAGAAGCCTGGCCCGGTTCTGC | 5' UTR 1 | 3' UTR 1 | 257 |
| Construct 96 | ATGCCCCGGCTTTTCTTCTTCCACTTACTCGGC GTGTGCCTTCTCCTTAACCAGTTCAGCCGGGC CGTGGCCGACAGCTGGATGGAGGAGGTGATC AAGCTCTGCGGCCGGGAGCTCGTGCGGGCCC AGATCGCCATCTGCGGCATGAGCACCTGGAGC GAGCCCAAGAGCAGCGACAAGACCCACACCA GTCCACCGTCCCCTGCCCCGAGTTACTGGGC GGCAGCAGCGTGTTCCTGTTCCCACCAAAGCC CAAGGACACCCTGTACATCACCCGGGAGCCC GAGGTGACCTGCGTGGTGGTGGACGTGAGCC ACGAGGACCCTGAGGTCAAGTTCAACTGGTAC GTGGACGGCGTGGAGGTGCACAACGCCAAGA CCAAGCCCCGGGAGGAGCAGTACAACAGCAC CTACCGGGTGGTGAGCGTGCTGACCGTGCTGC ACCAGGACTGGCTGAACGGCAAGGAGTACAA GTGCAAGGTGAGCAACAAGGCCCTGCCTGCC CCGATCGAGAAGACCATCAGCAAGGCCAAGG GCCAGCCTCGCGAGCCTCAGGTGTACACCCTG CCACCAAGCCGGGACGAGCTGACCAAGAACC AGGTGAGCCTGACCTGCCTGGTGAAGGGCTTC TACCCCAGCGACATCGCCGTGGAGTGGGAGA GCAACGGCCAGCCAGAGAACAACTACAAGAC CACACCACCCGTGCTGGACAGCGACGGCAGC TTCTTCCTGTACAGCAAGCTGACAGTGGACAA GAGCCGGTGGCAGCAGGGCAACGTGTTCAGC TGCAGCGTGATGCACGAGGCCCTACACAACC ACTACACCCAGAAGTCCCTGTCTCTGTCACCC GGCAAGCGGAAGAAGAGATCCCTGAGCCAGG AGGACGCCCCGCAGACCCCCGGCCAGTGGC CGAGATCGTGCCCAGCTTCATCAACAAGGATA CCGAGACGATCAACATGATGAGCGAGTTCGT GGCCAACCTGCCCCAGGAGCTGAAGCTCACA | 5' UTR 1 | 3' UTR 1 | 258 |

TABLE 6-continued

DNA Sequences

| Name | ORF Sequence | 5' UTR | 3' UTR | SEQ ID NO: |
|---|---|---|---|---|
| | CTGAGCGAGATGCAGCCCGCCCTGCCGCAACT<br>CCAGCAGCACGTGCCAGTGCTGAAGGACAGC<br>AGCCTGCTGTTCGAGGAGTTCAAGAAGCTGAT<br>CCGGAACCGGCAGAGCGAGGCCGCTGACAGC<br>TCTCCTAGCGAACTGAAGTACCTGGGCCTGGA<br>CACCCACAGCAGGAAGAAGCGGCAGCTGTAC<br>TCAGCCCTGGCCAACAAGTGCTGCCACGTGGG<br>CTGCACTAAGAGAAGCCTCGCCCGGTTCTGC | | | |
| Construct 97 | ATGCCCAGACTGTTCTTCTTCCACCTCCTCGGC<br>GTGTGCCTCCTCCTCAACCAGTTCAGCCGGGC<br>CGTGGCCGACAGCTGGATGGAGGAGGTGATC<br>AAGCTATGCGGCCGGGAGCTCGTGCGGGCCC<br>AGATCGCCATCTGCGGCATGAGCACCTGGAGC<br>GAGCCCAAGAGCAGCGACAAGACCCACACCT<br>CCCCGCCGTCCCCAGCTCCCGAGCTGTTAGGA<br>GGCAGCAGCGTGTTCCTGTTCCCGCCTAAGCC<br>CAAGGACACCCTGTACATCACCCGGGAGCCC<br>GAGGTGACCTGCGTGGTGGTGGACGTGAGCC<br>ACGAGGACCCGGAGGTGAAGTTCAACTGGTA<br>CGTGGACGGCGTGGAGGTGCACAACGCCAAG<br>ACCAAGCCCCGGGAGGAGCAGTACAACAGCA<br>CCTACCGGGTGGTGAGCGTGCTGACCGTGCTG<br>CACCAGGACTGGCTGAACGGCAAGGAGTACA<br>AGTGCAAGGTGAGCAACAAGGCCCTGCCTGC<br>ACCTATCGAGAAGACCATCAGCAAGGCCAAG<br>GGCCAGCCAAGAGAGCCTCAGGTGTACACCC<br>TGCCACCTAGCCGGGACGAGCTGACCAAGAA<br>CCAGGTGAGCCTGACCTGCCTGGTGAAGGGCT<br>TCTACCCCAGCGACATCGCCGTGGAGTGGGAG<br>AGCAACGGCCAGCCTGAGAACAACTACAAGA<br>CCACTCCCACCCGTGCTGGACAGCGACGGCAGC<br>TTCTTCCTGTACAGCAAGCTCACCGTGGACAA<br>GAGCCGGTGGCAGCAGGGCAACGTGTTCAGC<br>TGCAGCGTGATGCACGAGGCTCTGCACAACCA<br>CTACACCCAGAAGAGTCTGTCGCTGAGCCCCG<br>GCAAGCGGAAGAAGAGAAGCCTGAGCCAGGA<br>GGACGCCCCGCAGACCCCCCGGCCAGTGGCA<br>GAGATCGTGCCCAGCTTCATCAACAAGGATAC<br>CGAGACAATTAACATGATGAGCGAGTTCGTG<br>GCCAACCTGCCCCAGGAGCTGAAGCTGACCCT<br>GAGCGAGATGCAGCCCGCACTGCCTCAGTTGC<br>AGCAGCACGTGCCTGTGCTGAAGGACAGCAG<br>CCTGCTGTTCGAGGAGTTCAAGAAGCTGATCC<br>GGAACCGGCAGAGCGAGGCCGCCGACTCCAG<br>CCCATCTGAACTGAAGTACCTGGGCCTGGACA<br>CCCACAGCCGCAAGAAGCGCCAGCTGTACTCT<br>GCCCTGGCCAACAAGTGCTGCCACGTGGGATG<br>CACAAAGCGTTCCCTGGCCCGGTTCTGC | 5' UTR 1 | 3' UTR 1 | 259 |
| Construct 98 | ATGCCCCGGCTTTTCTTCTTCCACCTCCTCGGC<br>GTGTGCCTCCTCCTCAACCAGTTCAGCCGGGC<br>CGTGGCCGACAGCTGGATGGAGGAGGTGATC<br>AAGCTTTGCGGCCGGGAGCTCGTGCGGGCCCA<br>GATCGCCATCTGCGGCATGAGCACCTGGAGCG<br>AGCCCAAGAGCAGCGACAAGACCCACACCAG<br>CCCACCTAGCCCGGCACCCGAGCTCCTGGGCG<br>GCAGCAGCGTGTTCCTGTTCCCTCCAAAGCCC<br>AAGGACACCCTGTACATCACCCGGGAGCCCG<br>AGGTGACCTGCGTGGTGGTGGACGTGAGCCA<br>CGAGGACCCTGAGGTGAAGTTCAACTGGTAC<br>GTGGACGGCGTGGAGGTGCACAACGCCAAGA<br>CCAAGCCCCGGGAGGAGCAGTACAACAGCAC<br>CTACCGGGTGGTGAGCGTGCTGACCGTGCTGC<br>ACCAGGACTGGCTGAACGGCAAGGAGTACAA<br>GTGCAAGGTGAGCAACAAGGCCCTGCCAGCC<br>CCTATCGAGAAGACCATCAGCAAGGCCAAGG<br>GCCAGCCTCGCGAGCCTCAGGTGTACACCCTG<br>CCTCCATCCCGGGACGAGCTGACCAAGAACC<br>AGGTGAGCCTGACCTGCCTGGTGAAGGGCTTC<br>TACCCCAGCGACATCGCCGTGGAGTGGGAGA<br>GCAACGGCCAGCCAGAGAACAACTACAAGAC<br>CACCCCTCCCGTGCTGGACAGCGACGGCAGCT<br>TCTTCCTGTACAGCAAGTTGACCGTCGACAAG | 5' UTR 1 | 3' UTR 1 | 260 |

TABLE 6-continued

DNA Sequences

| Name | ORF Sequence | 5' UTR | 3' UTR | SEQ ID NO: |
|---|---|---|---|---|
| | AGCCGGTGGCAGCAGGGCAACGTGTTCAGCT GCAGCGTGATGCACGAAGCCCTACACAACCA CTACACCCAGAAGTCCCTGAGCTTGAGCCCCG GCAAGCGGAAGAAGCGCTCCTTGTCCCAGGA GGACGCCCCGCAAACCCCCCGGCCAGTGGCC GAGATCGTGCCCAGCTTCATCAACAAGGATAC AGAGACAATTAACATGATGAGCGAGTTCGTG GCCAACCTGCCCCAGGAGCTGAAGCTCACACT GAGCGAGATGCAGCCCGCTCTGCCACAGCTCC AGCAGCACGTGCCTGTGCTGAAGGACAGCAG CCTGCTGTTCGAGGAGTTCAAGAAGCTGATCC GGAACCGGCAGAGCGAGGCCGCCGACTCCTC CCCAAGCGAGCTCAAGTACCTGGGCCTGGAC ACCCACAGCAGAAAGAAGAGGCAGCTCTACA GCGCCCTGGCCAACAAGTGCTGCCACGTGGGC TGTACCAAGAGAAGCCTGGCCCGGTTCTGC | | | |
| Construct 99 | ATGCCCAGACTGTTCTTCTTCCACTTATTGGGC GTGTGCTTGCTTCTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCG AGCCCAAGTCCTCCGACAAGACCCACACCTCC CCGCCTTCCCCTGCACCCGAGCTCCTCGGCGG CTCCTCCGTCTTCCTCTTCCCTCCTAAGCCCAA GGACACCCTCTACATCACCCGCGAGCCCGAGG TCACCTGCGTCGTCGTCGACGTCTCCCACGAG GACCCTGAGGTGAAGTTCAACTGGTACGTCGA CGGCGTCGAGGTCCACAACGCCAAGACCAAG CCCCGCGAGGAGCAGTACAACTCCACCTACCG CGTCGTCTCCGTCCTCACCGTCCTCCACCAGG ACTGGCTCAACGGCAAGGAGTACAAGTGCAA GGTGTCCAACAAGGCCCTGCCTGCCCCAATCG AGAAGACCATCTCCAAGGCCAAGGGCCAGCC ACGGGAACCTCAGGTCTACACCCTGCCTCCTA GCCGCGACGAGCTCACCAAGAACCAGGTGTC CCTCACCTGCCTCGTCAAGGGCTTCTACCCTTC TGATATCGCCGTCGAGTGGGAGTCCAACGGTC AGCCTGAGAACAACTACAAGACCACCCCTCCC GTCCTCGACTCCGACGGCTCCTTCTTCCTGTAC TCCAAGCTGACCGTGGACAAGTCCCGCTGGCA GCAGGGCAACGTCTTCTCCTGCTCCGTCATGC ACGAGGCTCTGCACAACCACTACACCCAGAA GTCCCTGAGCCTGAGCCCCGGCAAGCGCAAG AAGAGAAGCCTGTCACAGGAGGACGCCCCCC AGACCCCTCGCCCTGTCGCCGAGATCGTCCCC TCCTTCATCAATAAGGACACGGAGACAATCAA CATGATGTCCGAGTTCGTCGCCAACCTGCCGC AGGAGCTGAAGCTCACCCTCTCCGAGATGCAG CCCGCCCTTCCTCAGCTCCAGCAGCACGTGCC TGTCCTGAAGGACTCCTCCCTCCTCTTCGAGG AGTTCAAGAAGCTCATCCGCAACCGCCAGTCC GAGGCCGCCGATAGCTCGCCTTCCGAGCTAAA GTACCTCGGCCTCGACACCCACTCCCGGAAGA AGAGGCAGCTGTATAGCGCCCTCGCCAACAA GTGCTGCCACGTCGGCTGCACCAAGAGGAGC CTGGCCCGCTTCTGC | 5' UTR 1 | 3' UTR 1 | 261 |
| Construct 100 | ATGCCCCGTCTGTTCTTCTTCCACCTTCTCGGC GTGTGCCTCCTACTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCG AGCCCAAGTCCTCCGACAAGACCCACACCTCG CCTCCTAGCCCAGCCCCCGAGCTCCTCGGCGG CTCCTCCGTCTTCCTCTTCCCACCGAAGCCCAA GGACACCCTCTACATCACCCGCGAGCCCGAGG TCACCTGCGTCGTCGTCGACGTCTCCCACGAG GACCCAGAGGTGAAGTTCAACTGGTACGTCG ACGGCGTCGAGGTCCACAACGCCAAGACCAA GCCCCGCGAGGAGCAGTACAACTCCACCTACC GCGTCGTCTCCGTCCTCACCGTCCTCCACCAG GACTGGCTCAACGGCAAGGAGTACAAGTGCA AGGTGTCCAACAAGGCCCTGCCAGCCCCAATC | 5' UTR 1 | 3' UTR 1 | 262 |

TABLE 6-continued

DNA Sequences

| Name | ORF Sequence | 5' UTR | 3' UTR | SEQ ID NO: |
|------|--------------|--------|--------|------------|
| | GAGAAGACCATCTCCAAGGCCAAGGGCCAAC<br>CTAGAGAGCCTCAGGTCTACACCTTGCCTCCA<br>AGTCGCGACGAGCTCACCAAGAACCAGGTGT<br>CCCTCACCTGCCTCGTCAAGGGCTTCTACCCA<br>AGCGACATCGCCGTCGAGTGGGAGTCCAACG<br>GCCAGCCTGAGAACAACTACAAGACCACCCC<br>GCCCGTCCTCGACTCCGACGGCTCCTTCTTCCT<br>GTACTCCAAGCTGACCGTCGACAAGTCCCGCT<br>GGCAGCAGGGCAACGTCTTCTCCTGCTCCGTC<br>ATGCACGAGGCTCTGCACAACCACTACACCCA<br>GAAGTCCCTGAGCCTGAGCCCCGGCAAGCGC<br>AAGAAGAGAAGCCTCAGCCAGGAGGACGCCC<br>CCCAGACCCCTAGACCGGTCGCCGAGATCGTC<br>CCCTCCTTCATCAATAAGGACACAGAGACAAT<br>CAACATGATGTCCGAGTTCGTCGCCAATCTGC<br>CTCAGGAGCTTAAGCTCACCCTCTCCGAGATG<br>CAGCCCGCTTTGCCTCAGCTCCAGCAGCACGT<br>GCCTGTGCTGAAGGACTCCTCCCTCCTCTTCG<br>AGGAGTTCAAGAAGCTCATCCGCAACCGCCA<br>GTCCGAGGCCGCCGACTCAAGCCCATCCGAGC<br>TGAAGTACCTCGGCCTCGACACCCACTCCCGG<br>AAGAAGAGGCAGCTCTACTCCGCCCTCGCCAA<br>CAAGTGCTGCCACGTCGGCTGCACCAAGCGGT<br>CCCTCGCCCGCTTCTGC | | | |
| Construct 101 | ATGCCCCGGTTGTTCTTCTTCCACCTTTTGGGC<br>GTGTGCCTTCTCTTGAACCAGTTCAGCCGGGC<br>CGTGGCCGACAGCTGGATGGAGGAGGTCATC<br>AAGCTCTGCGGCCGCGAGCTCGTCCGCGCCCA<br>GATCGCCATCTGCGGCATGTCCACCTGGTCCG<br>AGCCCAAGTCCTCCGACAAGACCCACACCTCT<br>CCTCCAAGCCCTGCGCCCGAGCTCCTCGGCGG<br>CTCCTCCGTCTTCCTCTTCCCACCAAAGCCCAA<br>GGACACCCTCTACATCACCCGCGAGCCCGAGG<br>TCACCTGCGTCGTCGTCGACGTCTCCCACGAG<br>GACCCAGAGGTCAAGTTCAACTGGTACGTCGA<br>CGGCGTCGAGGTCCACAACGCCAAGACCAAG<br>CCCCGCGAGGAGCAGTACAACTCCACCTACCG<br>CGTCGTCTCCGTCCTCACCGTCCTCCACCAGG<br>ACTGGCTCAACGGCAAGGAGTACAAGTGCAA<br>GGTGTCCAACAAGGCCCTCCCAGCCCCAATCG<br>AGAAGACCATCTCCAAGGCCAAGGGCCAACC<br>TAGAGAACCACAGGTCTACACACTCCCTCCTA<br>GCCGCGACGAGCTCACCAAGAACCAGGTGTC<br>CCTCACCTGCCTCGTCAAGGGCTTCTACCCAT<br>CCGATATCGCCGTCGAGTGGGAGTCCAACGG<br>ACAGCCGGAGAACAACTACAAGACCACACCT<br>CCCGTCCTCGACTCCGACGGCTCCTTCTTCCTG<br>TACTCCAAGCTGACCGTGGACAAGTCCCGCTG<br>GCAGCAGGGCAACGTCTTCTCCTGCTCCGTCA<br>TGCACGAGGCCCTGCACAACCACTACACCCAG<br>AAGTCCCTCTCCCTGAGCCCCGGCAAGCGCAA<br>GAAGAGAAGTCTTAGCCAGGAGGACGCCCCC<br>CAGACCCCTAGACCGGTCGCCGAGATCGTCCC<br>CTCCTTCATCAACAAGGATACAGAGACGATCA<br>ACATGATGTCCGAGTTCGTCGCCAACCTGCCA<br>CAGGAGCTGAAGCTGACACTCTCCGAGATGC<br>AGCCCGCCCTGCCTCAGCTCCAGCAGCACGTG<br>CCAGTGCTGAAGGACTCCTCATTACTCTTCGA<br>GGAGTTCAAGAAGCTCATCCGCAACCGCCAGT<br>CCGAGGCCGCCGACTCTAGCCCTTCCGAGCTC<br>AAGTACCTCGGCCTCGACACCCACTCCCGGAA<br>GAAGCGGCAGCTGTACAGCGCCCTCGCCAAC<br>AAGTGCTGCCACGTCGGCTGCACCAAGCGGTC<br>CCTTGCCCGCTTCTGC | 5' UTR 1 | 3' UTR 1 | 263 |
| Construct 102 | ATGCCCCGGCTATTCTTCTTCCACTTACTCGGC<br>GTGTGCCTCCTCTTGAACCAGTTCAGCCGGGC<br>CGTGGCCGACAGCTGGATGGAGGAGGTGATC<br>AAGCTTTGCGGCCGGGAGCTTGTGCGGGCCCA<br>GATCGCCATCTGCGGCATGAGCACCTGGAGCG<br>AGCCCAAGAGCAGCGACAAGACCCACACCAG<br>CCCTCCTTCCCCTGCCCCCGAGTTGCTGGGAG<br>GCAGCAGCGTGTTCCTGTTCCCACCGAAGCCC | 5' UTR 1 | 3' UTR 1 | 264 |

TABLE 6-continued

DNA Sequences

| Name | ORF Sequence | 5' UTR | 3' UTR | SEQ ID NO: |
|---|---|---|---|---|
| | AAGGACACCCTGTACATCACCCGGGAGCCCG<br>AGGTGACCTGCGTGGTGGTGGACGTGAGCCA<br>CGAGGACCCAGAGGTGAAGTTCAACTGGTAC<br>GTGGACGGCGTGGAGGTGCACAACGCCAAGA<br>CCAAGCCCCGGGAGGAGCAGTACAACAGCAC<br>CTACCGGGTGGTGAGCGTGCTGACCGTGCTGC<br>ACCAGGACTGGCTGAACGGCAAGGAGTACAA<br>GTGCAAGGTGAGCAACAAGGCCCTGCCAGCC<br>CCTATCGAGAAGACCATCAGCAAGGCCAAGG<br>GCCAGCCTAGGGAGCCACAGGTGTACACCCT<br>GCCACCTAGCCGGGACGAGCTGACCAAGAAC<br>CAGGTGAGCCTGACCTGCCTGGTGAAGGGCTT<br>CTACCCCAGCGACATCGCCGTGGAGTGGGAG<br>AGCAACGGCCAGCCGGAGAACAACTACAAGA<br>CCACCCCACCCGTGCTGGACAGCGACGGCAG<br>CTTCTTCCTGTACAGCAAGCTGACGGTGGACA<br>AGAGCCGGTGGCAGCAGGGCAACGTGTTCAG<br>CTGCAGCGTGATGCACGAGGCTCTGCACAACC<br>ACTACACCCAGAAGAGTTTAAGCTTGTCACCC<br>GGCAAGCGGAAGAAGCGGTCCCTGAGCCAGG<br>AGGACGCCCCTCAGACCCCCAGACCTGTTGCC<br>GAGATCGTGCCCAGCTTCATCAATAAGGATAC<br>CGAAACCATCAACATGATGAGCGAGTTCGTG<br>GCCAACCTGCCCCAGGAGCTGAAGCTGACCCT<br>GAGCGAGATGCAGCCCGCCCTGCCTCAGTTGC<br>AGCAGCACGTGCCTGTGCTGAAGGACAGCAG<br>CCTGCTGTTCGAGGAGTTCAAGAAGCTGATCC<br>GGAACCGGCAGAGCGAGGCCGCCGACTCCTC<br>CCCTAGCGAGCTCAAGTACCTGGGCCTGGACA<br>CCCACAGCAGAAAGAAGAGACAGCTCTACAG<br>CGCCCTGGCCAACAAGTGCTGCCACGTGGGTT<br>GCACCAAGCGCAGCCTGGCCCCGGTTCTGC | | | |
| Construct 103 | ATGCCCCGGTTATTCTTCTTCCACCTCCTCGGC<br>GTGTGCCTCTTGCTCAACCAGTTCAGCCGGGC<br>CGTGGCCGACAGCTGGATGGAGGAGGTGATC<br>AAGCTCTGCGGCCGGGAGTTGGTGCGGGCCC<br>AGATCGCCATCTGCGGCATGAGCACCTGGAGC<br>GAGCCCAAGAGCAGCGACAAGACCCACACCT<br>CCCCTCCTAGCCCGGCGCCCGAGCTGCTGGGA<br>GGCAGCAGCGTGTTCCTGTTCCCTCCTAAGCC<br>CAAGGACACCCTGTACATCACCCGGGAGCCC<br>GAGGTGACCTGCGTGGTGGTGGACGTGAGCC<br>ACGAGGACCCAGAGGTGAAGTTCAACTGGTA<br>CGTGGACGGCGTGGAGGTGCACAACGCCAAG<br>ACCAAGCCCCGGGAGGAGCAGTACAACAGCA<br>CCTACCGGGTGGTGAGCGTGCTGACCGTGCTG<br>CACCAGGACTGGCTGAACGGCAAGGAGTACA<br>AGTGCAAGGTGAGCAACAAGGCCCTGCCTGC<br>CCCTATCGAGAAGACCATCAGCAAGGCCAAG<br>GGCCAGCCACGCGAGCCTCAGGTGTACACCCT<br>GCCACCTAGCCGGGACGAGCTGACCAAGAAC<br>CAGGTGAGCCTGACCTGCCTGGTGAAGGGCTT<br>CTACCCCAGCGACATCGCCGTGGAGTGGGAG<br>AGCAACGGCCAGCCTGAGAACAACTACAAGA<br>CCACCCCTCCCGTGCTGGACAGCGACGGCAGC<br>TTCTTCCTGTACAGCAAGCTGACGGTGGACAA<br>GAGCCGGTGGCAGCAGGGCAACGTGTTCAGC<br>TGCAGCGTGATGCACGAGGCTCTGCACAACCA<br>CTACACCCAGAAGTCACTGAGCCTGTCACCCG<br>GCAAGCGGAAGAAGAAGCCTGTCCCAGGA<br>GGACGCACCTCAGACCCCCGGCCTGTGGCCG<br>AGATCGTGCCCAGCTTCATCAATAAGGATACC<br>GAAACCATCAACATGATGAGCGAGTTCGTGG<br>CCAACCTGCCCCAGGAGCTGAAGCTGACCCTG<br>AGCGAGATGCAGCCCGCTCTGCCTCAGCTTCA<br>GCAGCACGTGCCTGTCCTGAAGGACAGCAGC<br>CTGCTGTTCGAGGAGTTCAAGAAGCTGATCCG<br>GAACCGGCAGAGCGAGGCCGCCGACTCTAGC<br>CCTAGCGAACTCAAGTACCTGGGCCTGGACAC<br>CCACAGCAGAAAGAAGCGCAGCTCTACAGC<br>GCCCTGGCCAACAAGTGCTGCCACGTGGGATG<br>CACCAAGCGAAGCCTGGCCCGGTTCTGC | 5' UTR 1 | 3' UTR 1 | 265 |

TABLE 6-continued

DNA Sequences

| Name | ORF Sequence | 5' UTR | 3' UTR | SEQ ID NO: |
|---|---|---|---|---|
| Construct 104 | ATGCCCAGACTCTTCTTCTTCCACCTTTTGGGC GTGTGCCTCCTCCTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCG AGCCCAAGTCCTCCGACAAGACCCACACCTCC CCGCCTAGCCCTGCCCCCGAGCTCCTCGGCGG CTCCTCCGTCTTCCTCTTCCCTCCAAAGCCCAA GGACACCCTCTACATCACCCGCGAGCCCGAGG TCACCTGCGTCGTCGTCGACGTCTCCCACGAG GACCCGGAGGTGAAGTTCAACTGGTACGTCG ACGGCGTCGAGGTCCACAACGCCAAGACCAA GCCCCGCGAGGAGCAGTACAACTCCACCTACC GCGTCGTCTCCGTCCTCACCGTCCTCCACCAG GACTGGCTCAACGGCAAGGAGTACAAGTGCA AGGTATCCAACAAGGCCCTGCCTGCTCCTATC GAGAAGACCATCTCCAAGGCCAAGGGCCAAC CTAGAGAGCCACAGGTCTACACCCTGCCTCCG TCCCGCGACGAGCTCACCAAGAACCAGGTGTC CCTCACCTGCCTCGTCAAGGGCTTCTACCCCTA GCGACATCGCCGTCGAGTGGGAGTCCAACGG CCAGCCTGAGAACAACTACAAGACCACCCCTC CCGTCCTCGACTCCGACGGCTCCTTCTTCCTTT ACTCCAAGCTGACCGTCGACAAGTCCCGCTGG CAGCAGGGCAACGTCTTCTCCTGCTCCGTCAT GCACGAGGCCCTCCACAACCACTACACCCAG AAGTCCCTCTCGCTCTCCCCCGGCAAGCGCAA GAAGAGATCCCTGTCGCAGGAGGACGCCCCC CAGACCCCTAGACCGGTCGCCGAGATCGTCCC CTCCTTCATCAATAAGGACACAGAAACCATCA ACATGATGTCCGAGTTCGTCGCCAACTTGCCA CAGGAGCTGAAGCTCACCCTCTCCGAGATGCA GCCCGCCCTCCCACAGCTCCAGCAGCACGTGC CTGTCCTCAAGGACTCCTCCCTCCTCTTCGAG GAGTTCAAGAAGCTCATCCGCAACCGCCAGTC CGAGGCCGCCGATAGCTCACCTTCCGAGCTCA AGTACCTCGGCCTCGACACCCACTCCAGAAAG AAGCGGCAGCTGTACTCCGCCCTCGCCAACAA GTGCTGCCACGTCGGCTGCACCAAGAGAAGC CTCGCCCGCTTCTGC | 5' UTR 1 | 3' UTR 1 | 266 |
| Construct 105 | ATGCCCCGACTGTTCTTCTTCCACTTGCTTGGC GTGTGCCTCCTCTTAAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCG AGCCCAAGTCCTCCGACAAGACCCACACCTCT CCGCCAAGCCCAGCTCCCGAGCTCCTCGGCGG CTCCTCCGTCTTCCTCTTCCCTCCTAAGCCCAA GGACACCCTCTACATCACCCGCGAGCCCGAGG TCACCTGCGTCGTCGTCGACGTCTCCCACGAG GACCCAGAGGTCAAGTTCAACTGGTACGTCGA CGGCGTCGAGGTCCACAACGCCAAGACCAAG CCCCGCGAGGAGCAGTACAACTCCACCTACCG CGTCGTCTCCGTCCTCACCGTCCTCCACCAGG ACTGGCTCAACGGCAAGGAGTACAAGTGCAA GGTGTCCAACAAGGCCCTGCCTGCCCCCTATCG AGAAGACCATCTCCAAGGCCAAGGGCCAGCC TAGAGAGCCTCAGGTCTACACCCTGCCACCTT CGCGCGACGAGCTCACCAAGAACCAGGTGTC CCTCACCTGCCTCGTCAAGGGCTTCTACCCCAT CCGACATCGCCGTCGAGTGGGAGTCCAACGG CCAACCTGAGAACAACTACAAGACCACCCCA CCCGTCCTCGACTCCGACGGCTCCTTCTTCCTG TACTCCAAGCTGACCGTGGACAAGTCCCGCTG GCAGCAGGGCAACGTCTTCTCCTGCTCCGTCA TGCACGAAGCCCTGCACAACCACTACACCCAG AAGTCCCTCAGCTTGTCCCCCGGCAAGCGCAA GAAGCGGTCCCTGTCCCAGGAGGACGCCCCC AGACCCCTAGACCTGTCGCCGAGATCGTCCCC TCCTTCATCAATAAGGATACCGAGACTATCAA CATGATGTCCGAGTTCGTCGCCAACCTCCCAC AGGAGCTGAAGCTCACCCTCTCCGAGATGCAG CCCGCTCTGCCACAGCTCCAGCAGCACGTCCC | 5' UTR 1 | 3' UTR 1 | 267 |

TABLE 6-continued

| Name | ORF Sequence | 5' UTR | 3' UTR | SEQ ID NO: |
|---|---|---|---|---|
| | TGTGCTCAAGGACTCCTCCCTCCTCTTCGAGG<br>AGTTCAAGAAGCTCATCCGCAACCGCCAGTCC<br>GAGGCCGCCGACTCCAGCCCTAGCGAGCTCA<br>AGTACCTCGGCCTCGACACCCACTCCAGGAAG<br>AAGAGACAGCTCTACAGCGCCCTCGCCAACA<br>AGTGCTGCCACGTCGGCTGCACCAAGAGAAG<br>CCTGGCCCGCTTCTGC | | | |
| Construct 106 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTGATC<br>AAGCTGTGCGGCCGGGAGCTGGTGCGGGCCC<br>AGATCGCCATCTGCGGCATGAGCACCTGGAGC<br>GAGCCCAAGAGCAGCGACAAGACCCACACCA<br>GCCCCCCCAGCCCCGCCCCCGAGCTGCTGGGC<br>GGCAGCAGCGTGTTCCTGTTCCCCCCCAAGCC<br>CAAGGACACCCTGTACATCACCCGGGAGCCC<br>GAGGTGACCTGCGTGGTGGTGGACGTGAGCC<br>ACGAGGACCCCGAGGTGAAGTTCAACTGGTA<br>CGTGGACGGCGTGGAGGTGCACAACGCCAAG<br>ACCAAGCCCCGGGAGGAGCAGTACAACAGCA<br>CCTACCGGGTGGTGAGCGTGCTGACCGTGCTG<br>CACCAGGACTGGCTGAACGGCAAGGAGTACA<br>AGTGCAAGGTGAGCAACAAGGCCCTGCCCGC<br>CCCCATCGAGAAGACCATCAGCAAGGCCAAG<br>GGCCAGCCCCGGGAGCCCCAGGTGTACACCCT<br>GCCCCCCAGCCGGGACGAGCTGACCAAGAAC<br>CAGGTGAGCCTGACCTGCCTGGTGAAGGGCTT<br>CTACCCCAGCGACATCGCCGTGGAGTGGGAG<br>AGCAACGGCCAGCCCGAGAACAACTACAAGA<br>CCACCCCCCCCGTGCTGGACAGCGACGGCAGC<br>TTCTTCCTGTACAGCAAGCTGACCGTGGACAA<br>GAGCCGGTGGCAGCAGGGCAACGTGTTCAGC<br>TGCAGCGTGATGCACGAGGCCCTGCACAACC<br>ACTACACCCAGAAGAGCCTGAGCCTGAGCCC<br>CGGCAAGCGGAAGAAGCGGAGCCTGAGCCAG<br>GAGGACGCCCCCAGACCCCCCGGCCCGTGG<br>CCGAGATCGTGCCCAGCTTCATCAACAAGGAC<br>ACCGAGACCATCAACATGATGAGCGAGTTCGT<br>GGCCAACCTGCCCCAGGAGCTGAAGCTGACC<br>CTGAGCGAGATGCAGCCCGCCCTGCCCCAGCT<br>GCAGCAGCACGTGCCCGTGCTGAAGGACAGC<br>AGCCTGCTGTTCGAGGAGTTCAAGAAGCTGAT<br>CCGGAACCGGCAGAGCGAGGCCGCCGACAGC<br>AGCCCCAGCGAGCTGAAGTACCTGGGCCTGG<br>ACACCCACAGCCGGAAGAAGCGGCAGCTGTA<br>CAGCGCCCTGGCCAACAAGTGCTGCCACGTGG<br>GCTGCACCAAGCGGAGCCTGGCCCGGTTCTGC | 5' UTR 1 | 3' UTR 1 | 268 |
| Construct 107 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTGATC<br>AAGCTGTGCGGGAGGGAGCTGGTGAGGGCGC<br>AGATCGCGATCTGCGGGATGAGCACGTGGAG<br>CGAGCCGAAGAGCAGCGACAAGACGCACACG<br>AGCCCGCCGAGCCCGGCGCCGGAGCTGCTGG<br>GGGGGAGCAGCGTGTTCCTGTTCCCCGCCGAAG<br>CCGAAGGACACGCTGTACATCACGAGGGAGC<br>CGGAGGTGACGTGCGTGGTGGTGGACGTGAG<br>CCACGAGGACCCGGAGGTGAAGTTCAACTGG<br>TACGTGGACGGGGTGGAGGTGCACAACGCGA<br>AGACGAAGCCGAGGGAGGAGCAGTACAACAG<br>CACGTACAGGGTGGTGAGCGTGCTGACGGTG<br>CTGCACCAGGACTGGCTGAACGGGAAGGAGT<br>ACAAGTGCAAGGTGAGCAACAAGGCGCTGCC<br>GGCGCCGATCGAGAAGACGATCAGCAAGGCG<br>AAGGGGCAGCCGAGGGAGCCGCAGGTGTACA<br>CGCTGCCGCCGAGCAGGGACGAGCTGACGAA<br>GAACCAGGTGAGCCTGACGTGCCTGGTGAAG<br>GGGTTCTACCCGAGCGACATCGCGGTGGAGTG<br>GGAGAGCAACGGGCAGCCGGAGAACAACTAC<br>AAGACGACGCCGCCGGTGCTGGACAGCGACG<br>GGAGCTTCTTCCTGTACAGCAAGCTGACGGTG<br>GACAAGAGCAGGTGGCAGCAGGGGAACGTGT | 5' UTR 1 | 3' UTR 1 | 269 |

TABLE 6-continued

DNA Sequences

| Name | ORF Sequence | 5' UTR | 3' UTR | SEQ ID NO: |
|---|---|---|---|---|
| | TCAGCTGCAGCGTGATGCACGAGGCGCTGCAC AACCACTACACGCAGAAGAGCCTGAGCCTGA GCCCGGGGAAGAGGAAGAAGAGGAGCCTGAG CCAGGAGGACGCGCCGCAGACGCCGAGGCCG GTGGCGGAGATCGTGCCGAGCTTCATCAACAA GGACACGGAGACGATCAACATGATGAGCGAG TTCGTGGCGAACCTGCCGCAGGAGCTGAAGCT GACGCTGAGCGAGATGCAGCCGGCGCTGCCG CAGCTGCAGCAGCACGTGCCGGTGCTGAAGG ACAGCAGCCTGCTGTTCGAGGAGTTCAAGAA GCTGATCAGGAACAGGCAGAGCGAGGCGGCG GACAGCAGCCCGAGCGAGCTGAAGTACCTGG GGCTGGACACGCACAGCAGGAAGAAGAGGCA GCTGTACAGCGCGCTGGCGAACAAGTGCTGCC ACGTGGGTGCACGAAGAGGAGCCTGGCGAG GTTCTGC | | | |
| Construct 108 | ATGCCCCGGCTGTTCTTCTTCCACCTGCTGGGC GTGTGCCTGCTGCTGAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCG AGCCCAAGTCCTCCGACAAGACCCACACCTCC CCCCCCTCCCCCGCCCCCGAGCTCCTCGGCGG CTCCTCCGTCTTCCTCTTCCCCCCCAAGCCCAA GGACACCCTCTACATCACCCGCGAGCCCGAGG TCACCTGCGTCGTCGTCGACGTCTCCCACGAG GACCCCGAGGTCAAGTTCAACTGGTACGTCGA CGGCGTCGAGGTCCACAACGCCAAGACCAAG CCCCGCGAGGAGCAGTACAACTCCACCTACCG CGTCGTCTCCGTCCTCACCGTCCTCCACCAGG ACTGGCTCAACGGCAAGGAGTACAAGTGCAA GGTCTCCAACAAGGCCCTCCCCGCCCCCATCG AGAAGACCATCTCCAAGGCCAAGGGCCAGCC CCGCGAGCCCCAGGTCTACACCCTCCCCCCCT CCCGCGACGAGCTCACCAAGAACCAGGTCTCC CTCACCTGCCTCGTCAAGGGCTTCTACCCCTC CGACATCGCCGTCGAGTGGGAGTCCAACGGC CAGCCCGAGAACAACTACAAGACCACCCCCC CCGTCCTCGACTCCGACGGCTCCTTCTTCCTCT ACTCCAAGCTCACCGTCGACAAGTCCCGCTGG CAGCAGGGCAACGTCTTCTCCTGCTCCGTCAT GCACGAGGCCCTCCACAACCACTACACCCAG AAGTCCCTCTCCCTCTCCCCCGGCAAGCGCAA GAAGCGCTCCCTCTCCCAGGAGGACGCCCCCC AGACCCCCGCCCCGTCGCCGAGATCGTCCCC TCCTTCATCAACAAGGACACCGAGACCATCAA CATGATGTCCGAGTTCGTCGCCAACCTCCCCC AGGAGCTCAAGCTCACCCTCTCCGAGATGCAG CCCGCCCTCCCCCAGCTCCAGCAGCACGTCCC CGTCCTCAAGGACTCCTCCCTCCTCTTCGAGG AGTTCAAGAAGCTCATCCGCAACCGCCAGTCC GAGGCCGCCGACTCCTCCCCCTCCGAGCTCAA GTACCTCGGCCTCGACACCCACTCCCGCAAGA AGCGCCAGCTCTACTCCGCCCTCGCCAACAAG TGCTGCCACGTCGGCTGCACCAAGCGCTCCCT CGCCCGCTTCTGC | 5' UTR 1 | 3' UTR 1 | 270 |
| Construct 109 | ATGCCCCGCCTGTTCTTCTTCCACCTCCTCGGC GTCTGCCTCCTCCTCAACCAGTTCTCCCGCGCC GTGGCGGACAGCTGGATGGAGGAGGTGATCA AGCTCTGCGGCCGCGAGCTCGTGCGCGCCCAG ATCGCCATTTGCGGCATGGAGCCCAAGAGCTC CGACAAGACCCACACCAGCCCGCCCAGCCCC GCCCCTGAGCTGCTGGGCGGATCCAGCGTCTT CCTGTTTCCCCCCAAGCCCAAGGACACCCTGT ACATCACAAGGGAGCCCGAGGTCACCTGCGT GGTGGTGGACGTCAGCCACGAGGACCCCGAG GTGAAATTTAACTGGTACGTAGACGGCGTGGA GGTGCACAACGCCAAGACCAAGCCCAGGGAG GAGCAGTACAACAGCACCTACCGGGTGGTAA GCGTCCTGACCGTGCTGCACCAGGACTGGCTG AACGGCAAGGAGTATAAGTGCAAAGTGAGCA ACAAGGCCCTGCCCGCCCCCATCGAGAAGAC | 5' UTR 1 | 3' UTR 1 | 271 |

TABLE 6-continued

| Name | ORF Sequence | 5' UTR | 3' UTR | SEQ ID NO: |
|---|---|---|---|---|
| | CATCAGCAAGGCCAAGGGGCAGCCCCGGGAG CCACAGGTGTACACCCTGCCCCCCAGCAGGGA CGAGCTGACCAAGAACCAGGTGAGTCTCACA TGCCTGGTTAAGGGCTTCTACCCATCCGACAT CGCCGTGGAGTGGGAAAGCAACGGTCAGCCC GAGAACAACTACAAGACCACGCCCCCCGGTGC TGGACTCCGACGGCAGCTTCTTCCTGTACTCC AAGCTCACCGTGGACAAGTCCAGGTGGCAGC AGGGGAACGTGTTCAGCTGCAGCGTGATGCAT GAGGCACTGCACAACCACTACACGCAGAAGT CCCTGTCTCTGAGCCCAGGCAAGCGCAAGAGC ACCTGGAGCAAGAGGTCCCTGAGCCAAGAGG ACGCCCCCAGACCCCCCGGCCTGTGGCCGAG ATCGTGCCCAGCTTCATCAACAAGGACACCGA GACGATCAACATGATGAGCGAATTTGTGGCCA ATCTGCCCCAGGAGCTGAAGCTCACCCTCTCC GAAATGCAGCCCGCCCTCCCCCAACTGCAACA ACACGTCCCCGTGCTGAAGGACAGCAGCCTGC TGTTTGAGGAATTTAAGAAGCTCATCAGAAAC AGACAGAGCGAGGCCGCGGACTCCAGCCCCA GCGAGCTGAAGTACCTGGGCCTGGACACCCAT AGCAGGAAGAAGCGGCAGCTGTACAGCGCCC TCGCCAACAAGTGCTGCCACGTGGGCTGCACC AAGAGAAGCCTGGCCAGGTTCTGC | | | |
| Construct 110 | ATGCCCCGACTCTTCTTCTTCCACCTCCTCGGC GTGTGCCTCCTCCTCAACCAGTTCTCTCGAGC CGTGGCCGATTCCTGGATGGAGGAGGTGATCA AGCTCTGCGGCAGAGAACTCGTGAGAGCCCA GATCGCCATTTGTGGGATGGAGCCCAAGAGC AGCGACAAGACCCATACTAGCCCACCCTCCCC CGCCCCCGAGCTGCTGGGGGGCAGCAGCGTG TTCCTGTTTCCCCCGAAGCCCAAGGACACCCT GTACATCACCCGGGAGCCCGAGGTGACCTGC GTGGTTGTCGACGTGTCACACGAAGACCCCGA GGTGAAGTTCAACTGGTACGTGGACGGCGTCG AGGTGCACAACGCCAAGACCAAGCCCAGGGA GGAGCAGTACAACAGCACGTACAGAGTGGTG TCAGTCCTGACCGTCCTCCACCAGGATTGGCT CAACGGCAAAGAGTACAAGTGCAAGGTGAGC AACAAGGCCCTGCCCGCCCCCATCGAGAAGA CAATCTCCAAGGCCAAGGGCCAGCCGAGGGA GCCCCAGGTGTATACCCTGCCCCCCTCAAGGG ACGAGCTGACCAAGAATCAGGTGTCCCTCACA TGCCTGGTGAAGGGGTTCTACCCCAGCGACAT CGCCGTGGAGTGGGAGAGCAACGGACAGCCC GAGAACAACTACAAGACCACACCCCCCGTGC TGGACAGCGATGGAAGTTTCTTCCTGTATAGC AAACTGACCGTGGACAAATCACGGTGGCAGC AGGGCAACGTGTTCAGCTGCAGCGTGATGCAC GAAGCCCTGCACAACCACTACACCCAGAAGT CATTATCTCTGAGCCCCGGCAAGAGAAAGAG CACGTGGAGCAAGAGGAGCCTCTCCCAGGAG GACGCCCCCAGACCCCCCGGCCCGTGGCCGA GATCGTGCCCTCCTTTATTAACAAGGACACCG AGACAATCAACATGATGTCCGAGTTCGTCGCC AATCTGCCCCAGGAGCTCAAGCTCACCCTGAG CGAGATGCAGCCCGCTCTGCCCCAGCTGCAGC AACACGTGCCCGTGCTGAAGGACAGCAGCCT GCTGTTCGAGGAGTTCAAGAAGCTGATCCGCA ACCGGCAAAGCGAGGCCGCTGACAGCTCGCC CAGCGAGCTGAAGTACCTGGGGCTGGACACC CACAGCCGGAAGAAGCGGCAGCTGTACAGCG CCCTGGCCAACAAGTGCTGCCACGTGGGGTGC ACTAAGCGGAGCCTGGCCAGATTTTGC | 5' UTR 1 | 3' UTR 1 | 272 |
| Construct 111 | ATGCCCAGACTGTTCTTCTTTCACCTCCTCGGC GTGTGTCTTTTACTCAACCAATTTAGCAGAGC CGTGGCCGACTCTTGGATGGAGGAGGTGATCA AGCTCTGTGGCCGCGAGCTTGTCCGGGCCCAG ATCGCTATCTGCGGAATGGAGCCCAAGTCCTC CGACAAGACCCACACCTCCCCACCCAGTCCCG CCCCCGAGCTGCTCGGGGGCAGCAGCGTGTTC CTGTTCCCTCCTAAGCCCAAGGACACGCTGTA | 5' UTR 1 | 3' UTR 1 | 273 |

TABLE 6-continued

DNA Sequences

| Name | ORF Sequence | 5' UTR | 3' UTR | SEQ ID NO: |
|---|---|---|---|---|
| | CATCACCAGGGAGCCCGAGGTCACCTGCGTG GTGGTGGACGTGTCCCATGAGGACCCCGAGGT GAAGTTCAACTGGTACGTGGACGGCGTGGAG GTTCACAACGCTAAGACCAAGCCCCGCGAGG AACAGTACAACAGCACCTATCGGGTCGTGTCA GTTCTGACCGTCCTCCACCAGGACTGGCTGAA CGGCAAGGAGTACAAGTGCAAGGTGAGCAAC AAAGCCCTCCCCGCCCCGATCGAGAAGACCAT CAGCAAGGCCAAGGGCCAGCCCCGAGAGCCC CAGGTGTACACCCTTCCCCCCAGCAGGGACGA GCTCACAAAGAATCAGGTGAGCCTGACCTGCC TGGTGAAGGGCTTCTACCCCTCCGACATCGCG GTGGAATGGGAGAGCAACGGCCAGCCGGAGA ACAACTATAAGACAACACCCCCGTGCTGGAC AGCGACGGCAGCTTCTTCCTCTACAGCAAGCT GACCGTCGACAAGTCCAGATGGCAGCAGGGC AACGTGTTCAGCTGCTCCGTGATGCACGAAGC CCTGCACAATCACTACACTCAGAAATCCCTGT CCCTGAGCCCCGGCAAGCGGAAGTCCACCTG GAGTAAGCGGAGTCTGAGCCAGGAGGACGCC CCCCAAACCCCCGACCCGTGGCCGAGATCGT GCCCTCCTTCATCAATAAGGACACCGAGACTA TCAACATGATGAGCGAGTTCGTGGCCAACCTG CCCCAGGAGCTGAAGCTGACGCTGTCTGAGAT GCAGCCTGCCCTGCCCCAGCTGCAGCAGCACG TGCCAGTGCTGAAGGACAGCAGCCTGCTGTTC GAGGAGTTTAAGAAGCTAATCAGAAACCGCC AGTCCGAGGCCGCCGACAGCAGCCCCTCCGA GCTCAAGTACCTGGGCCTGGACACCCATTCCC GCAAGAAGAGGCAGCTGTACTCGGCCCTGGC CAACAAGTGCTGTCACGTCGGATGTACCAAGA GAAGTCTGGCCAGGTTCTGC | | | |
| Construct 112 | ATGCCGCGGCTTTTCTTCTTCCACCTCCTCGGC GTGTGCCTACTCCTTAACCAATTCTCCCGAGC CGTCGCCGACAGCTGGATGGAGGAGGTGATC AAACTCTGCGGCAGGGAGCTCGTGAGGGCCC AGATAGCCATCTGCGGCATGGAACCCAAGTCC AGCGACAAGACCCCACACCAGCCCGCCCAGCC CCGCCCCCGAGCTGCTGGGCGGCTCAAGCGTG TTCCTGTTCCCGCCCAAGCCCAAGGACACCCT GTACATCACCAGAGAGCCGGAGGTCACCTGC GTGGTGGTGGACGTGTCTCACGAGGACCCCGA AGTCAAGTTCAACTGGTACGTGGATGGCGTGG AGGTGCACAATGCAAAGACCAAGCCGAGAGA GGAACAGTACAACTCGACGTACCGGGTCGTG AGCGTCCTGACCGTGCTGCACCAGGACTGGCT GAATGGCAAGGAGTACAAGTGCAAAGTGTCG AATAAGGCCCTGCCCGCCCCCATCGAGAAGA CCATCTCCAAGGCCAAGGGCCAGCCCAGAGA ACCGCAGGTATACACCCTGCCCCCTTCCCGGG ACGAGCTGACCAAGAACCAGGTGTCTCTCACG TGCCTGGTGAAGGGCTTCTACCCCAGCGACAT CGCCGTGGAGTGGGAGTCCAATGGTCAGCCC GAGAACAACTATAAGACCACGCCGCCCGTGC TGGACTCAGACGGCTCCTTCTTCCTCTACAGC AAACTGACGGTGGACAAGAGCCGGTGGCAGC AGGGCAACGTGTTCTCCTGCAGCGTCATGCAC GAGGCCCTGCACAACCACTACACTCAGAAGTC CCTGAGCCTGAGCCCCGGGAAGCGAAAGTCT ACCTGGAGCAAGCGGAGCCTGAGCCAAGAGG ACGCCCCCCAAACACCCCGGCCCGTGGCCGA GATAGTGCCTAGCTTCATTAACAAGGACACCG AGACTATCAACATGATGAGCGAGTTCGTGGCG AACCTGCCCCAGGAGCTGAAGCTGACCCTGTC CGAGATGCAGCCGGCCCTGCCTCAGCTGCAGC AGCACGTGCCCGTGCTGAAGGACAGCAGCCT GCTGTTTGAGGAGTTCAAGAAGCTGATCCGCA ACCGCCAAAGCGAAGCCGCCGACTCCAGCCC TAGCGAGCTCAAGTACCTGGGCCTGGACACGC ACAGCAGGAAGAAGAGGCAGCTGTACAGCGC CCTGGCCAACAAGTGCTGCCACGTCGGGTGCA CCAAGAGGAGCCTGGCTAGGTTTTGC | 5' UTR 1 | 3' UTR 1 | 274 |

TABLE 6-continued

DNA Sequences

| Name | ORF Sequence | 5' UTR | 3' UTR | SEQ ID NO: |
|---|---|---|---|---|
| Construct 113 | ATGCCCCGCCTGTTCTTCTTCCACCTCCTTGGC GTGTGCCTCCTCCTAAATCAGTTCAGCCGCGC CGTGGCCGACAGCTGGATGGAGGAGGTGATC AAGCTCTGCGGGAGGGAGCTCGTGCGGGCCC AGATCGCCATCTGCGGCATGGAGCCCAAGTCC AGCGACAAGACCCACACCTCGCCCCCCAGCCC CGCCCCCGAGCTGCTGGGCGGGAGCAGCGTTT TCCTGTTTCCACCTAAGCCCAAGGACACTCTG TACATCACCAGAGAGCCCGAGGTCACATGCGT GGTGGTGGACGTGAGCCACGAGGACCCCGAG GTGAAGTTCAACTGGTACGTCGATGGCGTCGA GGTGCACAACGCCAAGACCAAGCCCAGGGAG GAGCAGTACAACAGCACCTACAGAGTGGTGT CCGTGCTGACCGTGCTGCACCAGGACTGGCTG AACGGAAAGGAGTACAAGTGCAAGGTGAGCA ACAAGGCCCTGCCCGCGCCGATCGAGAAGAC CATAAGCAAGGCCAAGGGCCAACCGAGGGAG CCCCAGGTGTACACCCTGCCCCCCAGCAGAGA CGAGCTGACCAAGAACCAGGTGAGCCTGACC TGCCTGGTCAAGGGCTTCTACCCCAGCGATAT CGCCGTGGAATGGGAGTCCAACGGACAGCCG GAGAACAACTACAAGACCACGCCCCCCGTGC TCGACAGCGACGGGTCCTTCTTCCTGTACTCG AAGCTGACCGTGGACAAGAGCCGCTGGCAGC AGGGCAACGTGTTCAGCTGCTCCGTGATGCAT GAGGCCCTGCACAACCACTATACGCAGAAGT CGCTCAGCCTGAGCCCCGGCAAGCGAAAGAG CACCTGGAGCAAGCGAAGCCTTAGCCAGGAG GATGCCCCCAGACACCCCGGCCAGTGGCTGA GATCGTCCCCAGCTTCATCAACAAAGACACTG AGACAATTAATATGATGAGCGAGTTCGTGGCC AATCTGCCCCAGGAGCTCAAGCTGACCCTCAG CGAGATGCAGCCCGCTCTGCCCCAGCTGCAAC AGCACGTTCCCGTGCTGAAGGACAGCTCTCTG CTGTTCGAGGAGTTCAAGAAGCTGATCAGGA ACCGACAGAGCGAGGCCGCCGACTCCAGCCC CTCGGAGCTCAAATACCTCGGCCTCGACACCC ACAGCAGGAAGAAGAGGCAGCTGTACAGCGC CCTGGCCAACAAGTGCTGCCACGTCGGCTGCA CCAAGAGGTCACTCGCCAGGTTCTGC | 5' UTR 1 | 3' UTR 1 | 275 |
| Construct 114 | ATGCCCCAGGCTGTTCTTCTTCCACCTCCTCGGC GTGTGCCTCCTCCTCAATCAGTTCAGCAGAGC CGTGGCCGATAGCTGGATGGAGGAGGTCATT AAGCTCTGCGGCAGAGAGCTCGTGCGAGCCC AGATCGCCATCTGCGGCATGGAGCCCAAGAG CAGCGATAAGACCCATACCTCTCCTCCCAGCC CCGCCCCCGAGCTGCTGGGCGGCTCCTCCGTG TTCCTGTTCCCTCCCAAGCCCAAAGCACCCCT GTACATCACCAGAGAACCCGAGGTGACCTGT GTCGTGGTGGACGTGAGCCACGAGGACCCGG AGGTGAAGTTCAATTGGTACGTGGATGGTGTC GAGGTGCACAACGCCAAGACGAAGCCCAGGG AGGAGCAGTATAACAGCACTTATCGCGTGGTC AGCGTGCTGACCGTCCTGCACCAAGACTGGCT GAACGGTAAGGAGTATAAGTGCAAGGTCAGC AACAAAGCCCTGCCCGCTCCCATCGAGAAGA CGATCAGCAAGGCCAAGGGCCAGCCCAGGGA GCCCCAGGTGTACACTCTGCCCCCCAGCAGAG ACGAGCTGACCAAGAATCAGGTGAGCCTGAC CTGCCTGGTGAAGGGGTTCTACCCCAGCGACA TCGCCGTCGAGTGGGAGAGCAACGGCCAGCC CGAGAACAACTATAAGACCACACCCCCGGTG CTGGACTCCGACGGAAGCTTCTTCCTGTACTC CAAGCTCACAGTTGACAAGAGCAGATGGCAG CAGGGCAATGTGTTCAGCTGCAGCGTGATGCA CGAGGCCCTCCACAACCACTACACCCAGAAAT CCCTCAGCCTGAGCCCCGGCAAGAGGAAGTC GACCTGGAGCAAGAGGAGCCTGTCCCAGGAG GACGCCCCCAAACGCCCCGGCCAGTGGCCGG AGATCGTCCCCAGCTTCATCAACAAGGACACC GAGACTATAAACATGATGAGCGAGTTCGTGG CCAACCTGCCCCAGGAGCTCAAGCTGACCCTG AGCGAGATGCAGCCCGCACTGCCCCAACTGC | 5' UTR 1 | 3' UTR 1 | 276 |

TABLE 6-continued

DNA Sequences

| Name | ORF Sequence | 5' UTR | 3' UTR | SEQ ID NO: |
|------|--------------|--------|--------|------------|
| | AGCAGCACGTGCCCGTGCTGAAGGACAGCAG<br>CCTCCTGTTCGAGGAGTTCAAGAAGCTGATCA<br>GGAACAGGCAGAGCGAGGCCGCCGACAGCAG<br>CCCCAGCGAGCTGAAGTACCTGGGACTGGAC<br>ACCCACAGCCGGAAGAAGCGCCAGCTCTACA<br>GCGCCCTGGCCAACAAGTGCTGCCATGTGGGG<br>TGCACCAAGCGGTCCCTGGCCCGGTTCTGC | | | |
| Construct 115 | ATGCCCCGACTGTTCTTCTTCCACCTCCTCGGC<br>GTGTGTCTCTTGCTTAATCAGTTCAGCCGCGC<br>CGTCGCCGACTCCTGGATGGAGGAAGTGATCA<br>AGCTCTGTGGCCGGGAGCTCGTGCGGGCTCAG<br>ATTGCAATCTGCGGGATGGAGCCCAAGTCGTC<br>CGACAAGACCCACACCAGCCCGCCCTCGCCCG<br>CCCCCGAGCTGCTTGGCGGCAGCAGCGTGTTC<br>CTGTTTCCCCCCAAGCCCAAGGACACCCTGTA<br>CATCACCCGGGAACCCGAGGTGACCTGCGTCG<br>TGGTGGACGTGTCCCACGAGGACCCCGAGGTC<br>AAGTTCAACTGGTACGTGGACGGCGTGGAGG<br>TGCACAATGCCAAGACCAAGCCCAGGGAGGA<br>GCAATACAACTCCACCTATCGGGTGGTGAGCG<br>TGCTGACCGTGCTGCACCAGGACTGGCTGAAC<br>GGCAAGGAGTACAAGTGCAAGGTGTCAAACA<br>AGGCGCTGCCCGCCCCCATCGAGAAGACAAT<br>CTCCAAGGCCAAGGGCCAGCCCCGGGAGCCC<br>CAGGTGTACACCCTGCCCCCCAGCCGGGACGA<br>GCTGACCAAGAACCAGGTTAGCCTTACATGCC<br>TGGTCAAGGGCTTCTACCCCTCCGACATCGCC<br>GTGGAGTGGGAGTCCAACGGCCAGCCCGAGA<br>ACAACTACAAGACCACACCCCCGTGCTGGAC<br>TCCGACGGCTCCTTCTTCCTTTACTCTAAGCTG<br>ACCGTGGACAAGAGCCGCTGGCAACAGGGCA<br>ATGTCTTCTCCTGCTCCGTGATGCACGAGGCC<br>CTGCACAATCACTACACCCAGAAGTCCCTGAG<br>CCTGTCCCCTGGAAAGCGGAAGTCCACCTGGA<br>GCAAGAGGAGCCTGTCCCAGGAGGATGCCCC<br>TCAGACCCCAGGCCCGTGGCCGAGATCGTGC<br>CTTCATTTATTAACAAGGACACCGAGACGATC<br>AACATGATGTCCGAGTTTGTGGCCAACCTGCC<br>CCAGGAGCTGAAGCTCACCCTCAGCGAAATG<br>CAGCCCGCCCTGCCCCAGCTGCAGCAGCACGT<br>GCCCGTGCTGAAGGACTCCTCGCTGCTCTTTG<br>AGGAGTTTAAGAAGCTGATCCGGAACAGGCA<br>GAGCGAGGCCGCAGATTCCAGCCCCTCGGAG<br>CTGAAGTACCTGGGCCTGGACACCCACAGCCG<br>GAAGAAGCGTCAGCTGTACAGCGCCCTGGCC<br>AACAAATGTTGTCACGTGGGCTGCACTAAGAG<br>GAGCCTGGCCAGATTTTGT | 5' UTR 1 | 3' UTR 1 | 277 |
| Construct 116 | ATGCCCCGGTTATTCTTCTTCCACTTGCTTGGC<br>GTGTGCCTCCTCCTCAACCAGTTCAGCCGGGC<br>CGTGGCCGACAGCTGGATGGAGGAGGTGATC<br>AAGCTATGCGGCCGGGAGCTCGTGCGGGCCC<br>AGATCGCCATCTGCGGCATGGAGCCCAAGAG<br>CAGCGACAAGACCCACACCTCCCCACCATCCC<br>CTGCCCCGAGCTGCTGGGAGGCAGCAGCGT<br>GTTCCTGTTCCCCACCTAAGCCCAAGGACACCC<br>TGTACATCACCCGGGAGCCCGAGGTGACCTGC<br>GTGGTGGTGGACGTGAGCCACGAGGACCCTG<br>AGGTGAAGTTCAACTGGTACGTGGACGGCGT<br>GGAGGTGCACAACGCCAAGACCAAGCCCCGG<br>GAGGAGCAGTACAACAGCACCTACCGGGTGG<br>TGAGCGTGCTGACCGTGCTGCACCAGGACTGG<br>CTGAACGGCAAGGAGTACAAGTGCAAGGTGA<br>GCAACAAGGCCCTGCCTGCCCCTATCGAGAAG<br>ACCATCAGCAAGGCCAAGGGCCAGCCTCGGG<br>AGCCACAGGTGTACACCCTGCCTCCTTCCCGG<br>GACGAGCTGACCAAGAACCAGGTGAGCCTGA<br>CCTGCCTGGTGAAGGGCTTCTACCCCAGCGAC<br>ATCGCCGTGGAGTGGGAGAGCAACGGTCAGC<br>CTGAGAACAACTACAAGACCACTCCACCCGTG<br>CTGGACAGCGACGGCAGCTTCTTCCTGTACAG<br>CAAGCTTACCGTCGACAAGAGCCGGTGGCAG<br>CAGGGCAACGTGTTCAGCTGCAGCGTGATGCA | 5' UTR 1 | 3' UTR 1 | 278 |

TABLE 6-continued

DNA Sequences

| Name | ORF Sequence | 5' UTR | 3' UTR | SEQ ID NO: |
|---|---|---|---|---|
| | CGAAGCCCTGCACAACCACTACACCCAGAAG<br>AGTCTGTCACTGAGCCCCGGCAAGAGGAAGT<br>CCACCTGGTCAAAGCGGAGCCTGAGCCAGGA<br>GGACGCTCCTCAAACCCCCCGGCCAGTGGCCG<br>AGATCGTGCCCAGCTTCATCAATAAGGACACA<br>GAGACAATCAACATGATGAGCGAGTTCGTGG<br>CCAACCTGCCCCAGGAGCTGAAGCTGACGCTC<br>AGCGAGATGCAGCCCGCCCTCCCTCAACTACA<br>GCAGCACGTGCCGGTGCTGAAGGACAGCAGC<br>CTGCTGTTCGAGGAGTTCAAGAAGCTGATCCG<br>GAACCGGCAGAGCGAGGCCGCTGACAGCTCC<br>CCTTCCGAGCTTAAGTACCTGGGCCTGGACAC<br>CCACAGCCGGAAGAAGAGGCAGCTGTACAGT<br>GCCCTGGCCAACAAGTGCTGCCACGTGGGCTG<br>CACTAAGAGGTCACTGGCCCGGTTCTGC | | | |
| Construct 117 | ATGCCCCGGCTTTTCTTCTTCCACTTACTCGGC<br>GTGTGCCTTCTCCTTAACCAGTTCAGCCGGGC<br>CGTGGCCGACAGCTGGATGGAGGAGGTGATC<br>AAGCTCTGCGGCCGGGAGCTCGTGCGGGCCC<br>AGATCGCCATCTGCGGCATGGAGCCCAAGAG<br>CAGCGACAAGACCCACACCAGCCCTCCTAGTC<br>CTGCGCCCGAGCTGCTTGGCGGCAGCAGCGTG<br>TTCCTGTTCCCACCGAAGCCCAAGGACACCCT<br>GTACATCACCCGGGAGCCCGAGGTGACCTGC<br>GTGGTGGTGGACGTGAGCCACGAGGACCCGG<br>AGGTGAAGTTCAACTGGTACGTGGACGGCGT<br>GGAGGTGCACAACGCCAAGACCAAGCCCCGG<br>GAGGAGCAGTACAACAGCACCTACCGGGTGG<br>TGAGCGTGCTGACCGTGCTGCACCAGGACTGG<br>CTGAACGGCAAGGAGTACAAGTGCAAGGTGA<br>GCAACAAGGCCCTGCCTGCCCCAATCGAGAA<br>GACCATCAGCAAGGCCAAGGGCCAACCACGA<br>GAGCCGCAGGTGTACACCCTGCCTCCTAGCCG<br>GGACGAGCTGACCAAGAACCAGGTGAGCCTG<br>ACCTGCCTGGTGAAGGGCTTCTACCCCAGCGA<br>CATCGCCGTGGAGTGGGAGAGCAACGGTCAG<br>CCTGAGAACAACTACAAGACCACACCTCCCGT<br>GCTGGACAGCGACGGCAGCTTCTTCCTGTACA<br>GCAAGCTGACAGTTGACAAGAGCCGGTGGCA<br>GCAGGGCAACGTGTTCAGCTGCAGCGTGATGC<br>ACGAGGCCCTGCACAACCACTACACCCAGAA<br>GAGTCTGTCTCTGTCCCCTGGCAAGAGGAAGT<br>CCACCTGGTCCAAGAGGTCCCTGAGCCAGGA<br>GGACGCCCCGCAGACCCCCCGGCCTGTGGCTG<br>AGATCGTGCCCAGCTTCATCAATAAGGATACC<br>GAGACAATCAACATGATGAGCGAGTTCGTGG<br>CCAATTTGCCCACAGGAGCTGAAGCTGACGCTG<br>AGCGAGATGCAGCCCGCCCTGCCGCAGCTCCA<br>GCAACACGTGCCTGTCCTGAAGGACAGCAGC<br>CTGCTGTTCGAGGAGTTCAAGAAGCTGATCCG<br>GAACCGGCAGAGCGAGGCCGCCGACTCTTCTC<br>CGTCCGAACTGAAGTACCTGGGCCTGGACACC<br>CACAGCCGGAAGAAGCGGCAGCTCTACTCCG<br>CCCTGGCCAACAAGTGCTGCCACGTGGGATGC<br>ACCAAGCGAAGCCTGGCCCGGTTCTGC | 5' UTR 1 | 3' UTR 1 | 279 |
| Construct 118 | ATGCCCCGGTTATTCTTCTTCCACTTATTAGGC<br>GTGTGCTTACTCCTCAACCAGTTCAGCCGGGC<br>CGTGGCCGACAGCTGGATGGAGGAGGTGATC<br>AAGCTCTGCGGCCGGGAGTTGGTGCGGGCCC<br>AGATCGCCATCTGCGGCATGGAGCCCAAGAG<br>CAGCGACAAGACCCACACCAGCCCTCCTAGCC<br>CTGCCCCCGAGCTGCTGGGAGGCAGCAGCGT<br>GTTCCTGTTCCCTCCGAAGCCCAAGGACACCC<br>TGTACATCACCCGGGAGCCCGAGGTGACCTGC<br>GTGGTGGTGGACGTGAGCCACGAGGACCCTG<br>AGGTGAAGTTCAACTGGTACGTGGACGGCGT<br>GGAGGTGCACAACGCCAAGACCAAGCCCCGG<br>GAGGAGCAGTACAACAGCACCTACCGGGTGG<br>TGAGCGTGCTGACCGTGCTGCACCAGGACTGG<br>CTGAACGGCAAGGAGTACAAGTGCAAGGTGA<br>GCAACAAGGCCCTGCCAGCTCCTATCGAGAA<br>GACCATCAGCAAGGCCAAGGGCCAGCCTAGA | 5' UTR 1 | 3' UTR 1 | 280 |

TABLE 6-continued

DNA Sequences

| Name | ORF Sequence | 5' UTR | 3' UTR | SEQ ID NO: |
|---|---|---|---|---|
| | GAGCCTCAGGTGTACACCCTGCCGCCAAGCCG GGACGAGCTGACCAAGAACCAGGTGAGCCTG ACCTGCCTGGTGAAGGGCTTCTACCCCAGCGA CATCGCCGTGGAGTGGGAGAGCAACGGACAG CCTGAGAACAACTACAAGACCACCCCACCCGT GCTGGACAGCGACGGCAGCTTCTTCCTGTACA GCAAGCTCACCGTGGACAAGAGCCGGTGGCA GCAGGGCAACGTGTTCAGCTGCAGCGTGATGC ACGAAGCCCTGCACAACCACTACACCCAGAA GTCCCTATCTCTGAGCCCCGGCAAGAGAAAGT CCACCTGGAGCAAGAGAAGTCTGAGCCAGGA GGACGCTCCACAGACCCCCCGGCCAGTGGCC GAGATCGTGCCCAGCTTCATCAACAAGGATAC AGAAACCATTAACATGATGAGCGAGTTCGTG GCCAACCTGCCCCAGGAGCTGAAGCTGACACT GAGCGAGATGCAGCCCGCTCTGCCTCAGCTTC AGCAGCACGTGCCTGTGCTGAAGGACAGCAG CCTGCTGTTCGAGGAGTTCAAGAAGCTGATCC GGAACCGGCAGAGCGAGGCCGCCGATAGCAG CCCTAGTGAACTCAAGTACCTGGGCCTGGACA CCCACAGCCGGAAGAAGCGGCAGCTGTATAG CGCCCTGGCCAACAAGTGCTGCCACGTGGGCT GCACAAAGCGTAGCCTGGCCCCGGTTCTGC | | | |
| Construct 119 | ATGCCCCGGCTTTTCTTCTTCCACCTCCTTGGC GTGTGCCTCCTCCTTAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGGAGCCCAAGTCCT CCGACAAGACCCACACCAGCCCGCCAAGCCC AGCCCCCGAGCTCCTCGGCGGCTCCTCCGTCT TCCTCTTCCCTCCAAAGCCCAAGGACACCCTC TACATCACCCGCGAGCCCGAGGTCACCTGCGT CGTCGTCGACGTCTCCCACGAGGACCCAGAGG TTAAGTTCAACTGGTACGTCGACGGCGTCGAG GTCCACAACGCCAAGACCAAGCCCCGCGAGG AGCAGTACAACTCCACCTACCGCGTCGTCTCC GTCCTCACCGTCCTCCACCAGGACTGGCTCAA CGGCAAGGAGTACAAGTGCAAGGTGTCCAAC AAGGCCCTGCCTGCCCCAATCGAGAAGACCAT CTCCAAGGCCAAGGGCCAGCCTCGGGAGCCT CAGGTCTACACCCTGCCACCTAGTCGCGACGA GCTCACCAAGAACCAGGTGTCCCTCACCTGCC TCGTCAAGGGCTTCTACCCTAGCGACATCGCC GTCGAGTGGGAGTCCAACGGCCAGCCAGAGA ACAACTACAAGACCACCCCTCCCGTCCTCGAC TCCGACGGCTCCTTCTTCCTGTACTCCAAGCTC ACTGTGGACAAGTCCCGCTGGCAGCAGGGCA ACGTCTTCTCCTGCTCCGTCATGCACGAAGCT CTCCACAACCACTACACCCAGAAGTCCCTCTC ACTGAGCCCCGGCAAGCGCAAGTCCACCTGGT CCAAGCGGAGCCTCTCGCAGGAGGACGCCCC CCAGACACCACGCCCTGTCGCCGAGATCGTCC CCTCCTTCATCAATAAGGACACGGAGACGATC AACATGATGTCCGAGTTCGTCGCCAACCTGCC ACAGGAGCTGAAGCTGACCCTCTCCGAGATGC AGCCCGCCCTGCCGCAGCTCCAGCAGCACGTG CCAGTGCTGAAGGACTCCTCCCTCCTCTTCGA GGAGTTCAAGAAGCTCATCCGCAACCGCCAGT CCGAGGCCGCTGACTCAAGCCCTTCAGAGCTT AAGTACCTCGGCCTCGACACCCACTCCCGCAA GAAGCGCCAGCTGTACAGCGCCCTCGCCAAC AAGTGCTGCCACGTCGGCTGCACAAAGCGAA GCCTGGCCCGCTTCTGC | 5' UTR 1 | 3' UTR 1 | 281 |
| Construct 120 | ATGCCCAGGCTGTTCTTCTTCCACCTCCTTGGC GTGTGCCTCTTACTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGGAGCCCAAGTCCT CCGACAAGACCCACCTCTCCACCGAGCCCA GCCCCCGAGCTCCTCGGCGGCTCCTCCGTCTT CCTCTTCCCTCCTAAGCCCAAGGACACCCTCT ACATCACCCGCGAGCCCGAGGTCACCTGCGTC | 5' UTR 1 | 3' UTR 1 | 282 |

TABLE 6-continued

DNA Sequences

| Name | ORF Sequence | 5' UTR | 3' UTR | SEQ ID NO: |
|---|---|---|---|---|
| | GTCGTCGACGTCTCCCACGAGGACCCAGAGGT<br>GAAGTTCAACTGGTACGTCGACGGCGTCGAG<br>GTCCACAACGCCAAGACCAAGCCCCGCGAGG<br>AGCAGTACAACTCCACCTACCGCGTCGTCTCC<br>GTCCTCACCGTCCTCCACCAGGACTGGCTCAA<br>CGGCAAGGAGTACAAGTGCAAGGTGTCCAAC<br>AAGGCCCTGCCTGCCCCTATCGAGAAGACCAT<br>CTCCAAGGCCAAGGGCCAGCCACGGGAGCCA<br>CAGGTCTACACACTGCCTCCGAGCCGCGACGA<br>GCTCACCAAGAACCAGGTGTCCCTCACCTGCC<br>TCGTCAAGGGCTTCTACCCTAGCGACATCGCC<br>GTCGAGTGGGAGTCCAACGGCCAGCCGGAGA<br>ACAACTACAAGACCACCCCGCCCGTCCTCGAC<br>TCCGACGGCTCCTTCTTCCTGTACTCCAAGCTG<br>ACAGTGGACAAGTCCCGCTGGCAGCAGGGCA<br>ACGTCTTCTCCTGCTCCGTCATGCACGAGGCT<br>CTGCACAACCACTACACCCAGAAGTCCCTCAG<br>CCTGTCTCCCGGCAAGCGCAAGTCCACCTGGT<br>CCAAGAGGAGCTTGTCCCAGGAGGACGCCCC<br>CCAGACTCCACGCCCTGTCGCCGAGATCGTCC<br>CCTCCTTCATCAATAAGGACACAGAGACGATC<br>AACATGATGTCCGAGTTCGTCGCCAACCTTCC<br>TCAGGAGCTGAAGCTGACCCTCTCCGAGATGC<br>AGCCCGCCCTGCCGCAGCTCCAGCAGCACGTG<br>CCAGTGCTCAAGGACTCCTCCCTCCTCTTCGA<br>GGGAGTTCAAGAAGCTCATCCGCAACCGCCAGT<br>CCGAGGCCGCCGACAGTAGCCCTTCCGAGCTC<br>AAGTACCTCGGCCTCGACACCCACTCCCGCAA<br>GAAGCGCCAGCTGTATTCAGCCCTCGCCAACA<br>AGTGCTGCCACGTCGGCTGCACGAAGCGGAG<br>CCTGGCCCGCTTCTGC | | | |
| Construct 121 | ATGCCCAGGTTGTTCTTCTTCCACCTTTTGGGC<br>GTGTGCCTCCTTCTCAACCAGTTCAGCCGGGC<br>CGTGGCCGACAGCTGGATGAGGAGGTCATC<br>AAGCTCTGCGGCCGCGAGCTCGTCCGCGCCCA<br>GATCGCCATCTGCGGCATGGAGCCCAAGTCCT<br>CCGACAAGACCCACACCTCTCCTCCGAGTCCA<br>GCACCCGAGCTCCTCGGCGGCTCCTCCGTCTT<br>CCTCTTCCCGCCTAAGCCCAAGGACACCCTCT<br>ACATCACCCGCGAGCCCGAGGTCACCTGCGTC<br>GTCGTCGACGTCTCCCACGAGGACCCAGAGGT<br>CAAGTTCAACTGGTACGTCGACGGCGTCGAGG<br>TCCACAACGCCAAGACCAAGCCCCGCGAGGA<br>GCAGTACAACTCCACCTACCGCGTCGTCTCCG<br>TCCTCACCGTCCTCCACCAGGACTGGCTCAAC<br>GGCAAGGAGTACAAGTGCAAGGTGTCCAACA<br>AGGCCCTTCCTGCCCCTATCGAGAAGACCATC<br>TCCAAGGCCAAGGGCCAGCCACGGGAGCCTC<br>AGGTCTACACCCTGCCTCCTAGCCGCGACGAG<br>CTCACCAAGAACCAGGTGTCCCTCACCTGCCT<br>CGTCAAGGGCTTCTACCCTAGCGACATCGCCG<br>TCGAGTGGGAGTCCAACGGTCAGCCTGAGAA<br>CAACTACAAGACCACCCCACCCGTCCTCGACT<br>CCGACGGCTCCTTCTTCCTTTACTCCAAGCTGA<br>CCGTGGACAAGTCCCGCTGGCAGCAGGGCAA<br>CGTCTTCTCCTGCTCCGTCATGCACGAGGCCC<br>TGCACAACCACTACACCCAGAAGTCCCTCTCT<br>CTGAGCCCCGGCAAGCGCAAGTCCACCTGGTC<br>CAAGAGATCTCTCAGCCAGGAGGACGCCCCC<br>CAGACCCCACGCCCAGTCGCCGAGATCGTCCC<br>CTCCTTCATCAACAAGGATACCGAAACCATCA<br>ACATGATGTCCGAGTTCGTCGCCAACCTGCCA<br>CAGGAGCTGAAGCTCACACTCTCCGAGATGCA<br>GCCCGCGCTCCCACAGCTCCAGCAGCACGTGC<br>CTGTGCTGAAGGACTCCTCCCTCCTCTTCGAG<br>GAGTTCAAGAAGCTCATCCGCAACCGCCAGTC<br>CGAGGCCGCCGACTCCAGTCCTAGCGAACTGA<br>AGTACCTCGGCCTCGACACCCACTCCCGCAAG<br>AAGCGCCAGCTGTACAGCGCCCTCGCCAACA<br>AGTGCTGCCACGTCGGCTGCACAAAGCGCAG<br>CCTGGCCCGCTTCTGC | 5' UTR 1 | 3' UTR 1 | 283 |

TABLE 6-continued

DNA Sequences

| Name | ORF Sequence | 5' UTR | 3' UTR | SEQ ID NO: |
|---|---|---|---|---|
| Construct 122 | ATGCCCCGGCTTTTCTTCTTCCACCTACTCGGC GTGTGCCTTCTCCTTAACCAGTTCAGCCGGGC CGTGGCCGACAGCTGGATGGAGGAGGTGATC AAGCTCTGCGGCCGGGAGCTTGTGCGGGCCCA GATCGCCATCTGCGGCATGGAGCCCAAGAGC AGCGACAAGACCCACACCTCTCCGCCGAGCCC AGCTCCCGAGCTCCTGGGCGGCAGCAGCGTGT TCCTGTTCCCACCAAAGCCCAAGGACACCCTG TACATCACCCGGGAGCCCGAGGTGACCTGCGT GGTGGTGGACGTGAGCCACGAGGACCCGGAG GTGAAGTTCAACTGGTACGTGGACGGCGTGG AGGTGCACAACGCCAAGACCAAGCCCCGGGA GGAGCAGTACAACAGCACCTACCGGGTGGTG AGCGTGCTGACCGTGCTGCACCAGGACTGGCT GAACGGCAAGGAGTACAAGTGCAAGGTGAGC AACAAGGCCCTGCCTGCCCCTATCGAGAAGAC CATCAGCAAGGCCAAGGGCCAGCCGCGGGAG CCTCAGGTGTACACCCTGCCTCCTTCTCGGGA CGAGCTGACCAAGAACCAGGTGAGCCTGACC TGCCTGGTGAAGGGCTTCTACCCCAGCGACAT CGCCGTGGAGTGGGAGAGCAACGGCCAGCCT GAGAACAACTACAAGACCACCCCTCCCGTGCT GGACAGCGACGGCAGCTTCTTCCTGTACAGCA AGTTAACCGTGGACAAGAGCCGGTGGCAGCA GGGCAACGTGTTCAGCTGCAGCGTGATGCACG AGGCACTGCACAACCACTACACCCAGAAGAG TCTGAGTCTCAGCCCCGGCAAGCGGAAGTCAA CCTGGAGCAAGCGAAGCCTGTCCCAGGAGGA CGCCCCTCAGACCCCCGGCCTGTGGCGGAGA TCGTGCCCAGCTTCATCAACAAGGATACCGAG ACAATAAACATGATGAGCGAGTTCGTGGCCA ACCTGCCCCAGGAGCTGAAGCTGACTCTGAGC GAGATGCAGCCCGCCTGCCACAATTGCAGCA GCACGTGCCTGTGCTGAAGGACAGCAGCCTGC TGTTCGAGGAGTTCAAGAAGCTGATCCGGAAC CGGCAGAGCGAGGCCGCCGACAGTAGCCCTA GCGAACTTAAGTACCTGGGCCTGGACACCCAC AGCCGGAAGAAGCGGCAGCTGTACTCCGCCC TGGCCAACAAGTGCTGCCACGTGGGCTGTACC AAGAGGAGCCTGGCCCGGTTCTGC | 5' UTR 1 | 3' UTR 1 | 284 |
| Construct 123 | ATGCCCCGGCTTTTCTTCTTCCACTTGCTCGGC GTGTGCCTACTTCTCAACCAGTTCAGCCGGGC CGTGGCCGACAGCTGGATGGAGGAGGTGATC AAGCTCTGCGGCCGGGAGCTCGTGCGGGCCC AGATCGCCATCTGCGGCATGGAGCCCAAGAG CAGCGACAAGACCCACACCTCTCCTCCTAGCC CTGCCCCCGAGCTCCTGGGCGGCAGCAGCGTG TTCCTGTTCCCACCTAAGCCCAAGGACACCCT GTACATCACCCGGGAGCCCGAGGTGACCTGC GTGGTGGTGGACGTGAGCCACGAGGACCCAG AAGTGAAGTTCAACTGGTACGTGGACGGCGT GGAGGTGCACAACGCCAAGACCAAGCCCCGG GAGGAGCAGTACAACAGCACCTACCGGGTGG TGAGCGTGCTGACCGTGCTGCACCAGGACTGG CTGAACGGCAAGGAGTACAAGTGCAAGGTGA GCAACAAGGCCCTGCCAGCCCCTATCGAGAA GACCATCAGCAAGGCCAAGGGACAGCCAAGA GAGCCTCAGGTGTACACCCTGCCACCTAGCCG GGACGAGCTGACCAAGAACCAGGTGAGCCTG ACCTGCCTGGTGAAGGGCTTCTACCCCAGCGA CATCGCCGTGGAGTGGGAGAGCAACGGCCAG CCTGAGAACAACTACAAGACCACCCCACCCGT GCTGGACAGCGACGGCAGCTTCTTCCTGTACA GCAAGCTCACAGTGGACAAGAGCCGGTGGCA GCAGGGCAACGTGTTCAGCTGCAGCGTGATGC ACGAGGCCTCCACAACCACTACACACAGAA GTCCCTGAGCCTTAGCCCCGGCAAGAGAAAG AGCACCTGGTCCAAGAGAAGTCTGTCCCAGG AGGACGCCCCTCAGACCCCCGGCCAGTGGCT GAGATCGTGCCCAGCTTCATCAACAAGGATAC AGAGACTATCAACATGATGAGCGAGTTCGTG GCCAACCTGCCCCAGGAGCTGAAGCTGACCCT | 5' UTR 1 | 3' UTR 1 | 285 |

TABLE 6-continued

DNA Sequences

| Name | ORF Sequence | 5' UTR | 3' UTR | SEQ ID NO: |
|---|---|---|---|---|
| | GAGCGAGATGCAGCCCGCCCTTCCACAACTGC AGCAGCACGTGCCAGTGCTGAAGGACAGCAG CCTGCTGTTCGAGGAGTTCAAGAAGCTGATCC GGAACCGGCAGAGCGAGGCCGCCGATAGCAG CCCAAGCGAACTCAAGTACCTGGGCCTGGAC ACCCCACAGCCGGAAGAAGCGGCAGCTGTACA GTGCCCTGGCCAACAAGTGCTGCCACGTGGGA TGCACCAAGCGGAGCCTGGCCCGGTTCTGC | | | |
| Construct 124 | ATGCCCCGGCTTTTCTTCTTCCACCTCTTGGGC GTGTGCCTCTTGCTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGGAGCCCAAGTCCT CCGACAAGACCCACACCAGCCCACCTTCACCG GCCCCCGAGCTCCTCGGCGGCTCCTCCGTCTT CCTCTTCCCACCTAAGCCCAAGGACACCCTCT ACATCACCCGCGAGCCCGAGGTCACCTGCGTC GTCGTCGACGTCTCCCACGAGGACCCAGAGGT GAAGTTCAACTGGTACGTCGACGGCGTCGAG GTCCACAACGCCAAGACCAAGCCCCGCGAGG AGCAGTACAACTCCACCTACCGCGTCGTCTCC GTCCTCACCGTCCTCCACCAGGACTGGCTCAA CGGCAAGGAGTACAAGTGCAAGGTTTCCAAC AAGGCCCTCCCAGCCCCAATCGAGAAGACCA TCTCCAAGGCCAAGGGCCAGCCTCGAGAGCC ACAGGTCTACACCCTGCCACCTTCCCGCGACG AGCTCACCAAGAACCAGGTGTCCCTCACCTGC CTCGTCAAGGGCTTCTACCCTTCCGACATCGC CGTCGAGTGGGAGTCCAACGGACAACCAGAG AACAACTACAAGACCACCCCGCCCGTCCTCGA CTCCGACGGCTCCTTCTTCCTGTACTCCAAGCT GACCGTGGACAAGTCCCGCTGGCAGCAGGGC AACGTCTTCTCCTGCTCCGTCATGCACGAGGC CCTGCACAACCACTACACCCAGAAGTCCCTCT CACTCTCCCCCGGCAAGCGCAAGTCCACCTGG TCCAAGAGATCCCTGTCCCAGGAGGACGCCCC CCAGACACCACGTCCTGTCGCCGAGATCGTCC CCTCCTTCATCAACAAGGATACAGAAACCATC AACATGATGTCCGAGTTCGTCGCCAACCTTCC TCAGGAGCTGAAGCTCACCCTCTCCGAGATGC AGCCCGCCTTGCCACAGCTCCAGCAGCACGTT CCTGTGCTCAAGGACTCCTCCCTCCTCTTCGA GGAGTTCAAGAAGCTCATCCGCAACCGCCAGT CCGAGGCCGCCGACTCCAGCCCTAGCGAGCTA AAGTACCTCGGCCTCGACACCCACTCCCGCAA GAAGCGCCAGCTCTATTCCGCCCTCGCCAACA AGTGCTGCCACGTCGGCTGCACAAAGAGAAG CCTCGCCCGCTTCTGC | 5' UTR 1 | 3' UTR 1 | 286 |
| Construct 125 | ATGCCCAGACTCTTCTTCTTCCACCTTCTCGGC GTGTGCCTCCTTCTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGGAGCCCAAGTCCT CCGACAAGACCCACACCAGCCCACCTAGCCC AGCCCCCGAGCTCCTCGGCGGCTCCTCCGTCT TCCTCTTCCCTCCGAAGCCCAAGGACACCCTC TACATCACCCGCGAGCCCGAGGTCACCTGCGT CGTCGTCGACGTCTCCCACGAGGACCCAGAGG TGAAGTTCAACTGGTACGTCGACGGCGTCGAG GTCCACAACGCCAAGACCAAGCCCCGCGAGG AGCAGTACAACTCCACCTACCGCGTCGTCTCC GTCCTCACCGTCCTCCACCAGGACTGGCTCAA CGGCAAGGAGTACAAGTGCAAGGTGTCCAAC AAGGCCCTGCCTGCCCCAATCGAGAAGACCAT CTCCAAGGCCAAGGGCCAGCCTAGAGAGCCT CAGGTCTACACCCTGCCTCCAAGCCGCGACGA GCTCACCAAGAACCAGGTTTCCCTCACCTGCC TCGTCAAGGGCTTCTACCCTTCTGACATCGCC GTCGAGTGGGAGTCCAACGGCCAGCCAGAGA ACAACTACAAGACCACCCCTCCCGTCCTCGAC TCCGACGGCTCCTTCTTCCTGTACTCCAAGCTG ACCGTGGACAAGTCCCGCTGGCAGCAGGGCA | 5' UTR 1 | 3' UTR 1 | 287 |

TABLE 6-continued

| | DNA Sequences | | | |
|---|---|---|---|---|
| Name | ORF Sequence | 5' UTR | 3' UTR | SEQ ID NO: |
| | ACGTCTTCTCCTGCTCCGTCATGCACGAGGCC CTCCACAACCACTACACCCAGAAGTCCCTCTC CCTCTCACCCGGCAAGCGCAAGTCCACCTGGT CCAAGCGGTCCCTGTCCCAGGAGGACGCCCCC CAGACCCCTCGGCCGGTCGCCGAGATCGTCCC CTCCTTCATCAACAAGGATACCGAGACGATCA ACATGATGTCCGAGTTCGTCGCCAATCTCCCA CAGGAGCTGAAGCTTACCCTCTCCGAGATGCA GCCCGCCCTGCCGCAGCTCCAGCAGCACGTGC CTGTCCTCAAGGACTCCTCCCTCCTCTTCGAG GAGTTCAAGAAGCTCATCCGCAACCGCCAGTC CGAGGCCGCCGATTCCTCTCCTTCCGAGCTCA AGTACCTCGGCCTCGACACCCACTCCCGCAAG AAGCGCCAGCTGTATTCCGCCCTCGCCAACAA GTGCTGCCACGTCGGCTGCACGAAGAGGAGC CTGGCCCGCTTCTGC | | | |
| Construct 126 | ATGCCCCGGCTGTTCTTCTTCCACCTGCTGGGC GTGTGCCTGCTGCTGAACCAGTTCAGCCGGGC CGTGGCCGACAGCTGGATGGAGGAGGTGATC AAGCTGTGCGGCCGGGAGCTGGTGCGGGCCC AGATCGCCATCTGCGGCATGGAGCCCAAGAG CAGCGACAAGACCCACACCAGCCCCCCCAGC CCCGCCCCCGAGCTGCTGGGCGGCAGCAGCGT GTTCCTGTTCCCCCCCAAGCCCAAGGACACCC TGTACATCACCCGGGAGCCCGAGGTGACCTGC GTGGTGGTGGACGTGAGCCACGAGGACCCCG AGGTGAAGTTCAACTGGTACGTGGACGGCGT GGAGGTGCACAACGCCAAGACCAAGCCCCGG GAGGAGCAGTACAACAGCACCTACCGGGTGG TGAGCGTGCTGACCGTGCTGCACCAGGACTGG CTGAACGGCAAGGAGTACAAGTGCAAGGTGA GCAACAAGGCCCTGCCCGCCCCCATCGAGAA GACCATCAGCAAGGCCAAGGGCCAGCCCCGG GAGCCCCAGGTGTACACCCTGCCCCCCAGCCG GGACGAGCTGACCAAGAACCAGGTGAGCCTG ACCTGCCTGGTGAAGGGCTTCTACCCCAGCGA CATCGCCGTGGAGTGGGAGAGCAACGGCCAG CCCGAGAACAACTACAAGACCACCCCCCCCGT GCTGGACAGCGACGGCAGCTTCTTCCTGTACA GCAAGCTGACCGTGGACAAGAGCCGGTGGCA GCAGGGCAACGTGTTCAGCTGCAGCGTGATGC ACGAGGCCCTGCACAACCACTACACCCAGAA GAGCCTGAGCCTGAGCCCCGGCAAGCGGAAG AGCACCTGGAGCAAGCGGAGCCTGAGCCAGG AGGACGCCCCCAGACCCCCCGGCCCGTGGCC GAGATCGTGCCCAGCTTCATCAACAAGGACAC CGAGACCATCAACATGATGAGCGAGTTCGTG GCCAACCTGCCCCAGGAGCTGAAGCTGACCCT GAGCGAGATGCAGCCCGCCCTGCCCCAGCTGC AGCAGCACGTGCCCGTGCTGAAGGACAGCAG CCTGCTGTTCGAGGAGTTCAAGAAGCTGATCC GGAACCGGCAGAGCGAGGCCGCCGACAGCAG CCCCAGCGAGCTGAAGTACCTGGGCCTGGAC ACCCACAGCCGGAAGAAGCGGCAGCTGTACA GCGCCCTGGCCAACAAGTGCTGCCACGTGGGC TGCACCAAGCGGAGCCTGGCCCGGTTCTGC | 5' UTR 1 | 3' UTR 1 | 288 |
| Construct 127 | ATGCCCCGGCTGTTCTTCTTCCACCTGCTGGGC GTGTGCCTGCTGCTGAACCAGTTCAGCCGGGC CGTGGCCGACAGCTGGATGGAGGAGGTGATC AAGCTGTGCGGGAGGGAGCTGGTGAGGGCGC AGATCGCGATCTGCGGGATGGAGCCGAAGAG CAGCGACAAGACGCACACGAGCCCGCCGAGC CCGGCCGCGGAGCTGCTGGGGGGGAGCAGCG TGTTCCTGTTCCCGCCGAAGCCGAAGGACACG CTGTACATCACGAGGGAGCCGGAGGTGACGT GCGTGGTGGTGGACGTGAGCCACGAGGACCC GGAGGTGAAGTTCAACTGGTACGTGGACGGG GTGGAGGTGCACAACGCGAAGACGAAGCCGA GGGAGGAGCAGTACAACAGCACGTACAGGGT GGTGAGCGTGCTGACGGTGCTGCACCAGGACT GGCTGAACGGGAAGGAGTACAAGTGCAAGGT GAGCAACAAGGCGCTGCCGGCGCCGATCGAG | 5' UTR 1 | 3' UTR 1 | 289 |

TABLE 6-continued

DNA Sequences

| Name | ORF Sequence | 5' UTR | 3' UTR | SEQ ID NO: |
|---|---|---|---|---|
| | AAGACGATCAGCAAGGCGAAGGGGCAGCCGA GGGAGCCGCAGGTGTACACGCTGCCGCCGAG CAGGGACGAGCTGACGAAGAACCAGGTGAGC CTGACGTGCCTGGTGAAGGGGTTCTACCCGAG CGACATCGCGGTGGAGTGGGAGAGCAACGGG CAGCCGGAGAACAACTACAAGACGACGCCGC CGGTGCTGGACAGCGACGGGAGCTTCTTCCTG TACAGCAAGCTGACGGTGGACAAGAGCAGGT GGCAGCAGGGGAACGTGTTCAGCTGCAGCGT GATGCACGAGGCGCTGCACAACCACTACACG CAGAAGAGCCTGAGCCTGAGCCCGGGGAAGA GGAAGAGCACGTGGAGCAAGAGGAGCCTGAG CCAGGAGGACGCGCCGCAGACGCCGAGGCCG GTGGCGGAGATCGTGCCGAGCTTCATCAACAA GGACACGGAGACGATCAACATGATGAGCGAG TTCGTGGCGAACCTGCCGCAGGAGCTGAAGCT GACGCTGAGCGAGATGCAGCCGGCGCTGCCG CAGCTGCAGCAGCACGTGCCGGTGCTGAAGG ACAGCAGCCTGCTGTTCGAGGAGTTCAAGAA GCTGATCAGGAACAGGCAGAGCGAGGCGGCG GACAGCAGCCCGAGCGAGCTGAAGTACCTGG GGCTGGACACGCACAGCAGGAAGAAGAGGCA GCTGTACAGCGCGCTGGCGAACAAGTGCTGCC ACGTGGGGTGCACGAAGAGGAGCCTGGCGAG GTTCTGC | | | |
| Construct 128 | ATGCCCCGGCTGTTCTTCTTCCACCTGCTGGGC GTGTGCCTGCTGCTGAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGGAGCCCAAGTCCT CCGACAAGACCCACACCTCCCCCCCCTCCCCC GCCCCCGAGCTCCTCGGCGGCTCCTCCGTCTT CCTCTTCCCCCCCAAGCCCAAGGACACCCTCT ACATCACCCGCGAGCCCGAGGTCACCTGCGTC GTCGTCGACGTCTCCCACGAGGACCCCGAGGT CAAGTTCAACTGGTACGTCGACGGCGTCGAGG TCCACAACGCCAAGACCAAGCCCCGCGAGGA GCAGTACAACTCCACCTACCGCGTCGTCTCCG TCCTCACCGTCCTCCACCAGGACTGGCTCAAC GGCAAGGAGTACAAGTGCAAGGTCTCCAACA AGGCCCTCCCCGCCCCCATCGAGAAGACCATC TCCAAGGCCAAGGGCCAGCCCCGCGAGCCCC AGGTCTACACCCTCCCCCCCTCCCGCGACGAG CTCACCAAGAACCAGGTCTCCCTCACCTGCCT CGTCAAGGGCTTCTACCCCTCCGACATCGCCG TCGAGTGGGAGTCCAACGGCCAGCCCGAGAA CAACTACAAGACCACCCCCCCCGTCCTCGACT CCGACGGCTCCTTCTTCCTCTACTCCAAGCTCA CCGTCGACAAGTCCCGCTGGCAGCAGGGCAA CGTCTTCTCCTGCTCCGTCATGCACGAGGCCC TCCACAACCACTACACCCAGAAGTCCCTCTCC CTCTCCCCCGGCAAGCGCAAGTCCACCTGGTC CAAGCGCTCCCTCTCCCAGGAGGACGCCCCCC AGACCCCCGCCCCGTCGCCGAGATCGTCCCC TCCTTCATCAACAAGGACACCGAGACCATCAA CATGATGTCCGAGTTCGTCGCCAACCTCCCCC AGGAGCTCAAGCTCACCCTCTCCGAGATGCAG CCCGCCCTCCCCCAGCTCCAGCAGCACGTCCC CGTCCTCAAGGACTCCTCCCTCCTCTTCGAGG AGTTCAAGAAGCTCATCCGCAACCGCCAGTCC GAGGCCGCCGACTCCTCCCCCTCCGAGCTCAA GTACCTCGGCCTCGACACCCACTCCCGCAAGA AGCGCCAGCTCTACTCCGCCCTCGCCAACAAG TGCTGCCACGTCGGCTGCACCAAGCGCTCCCT CGCCCGCTTCTGC | 5' UTR 1 | 3' UTR 1 | 290 |
| Construct 129 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCGG CAGCACAGACTCCGGCTCTGATACCAGCTCCG GCAACAGCGGCGATGGCAATTCCGGCCAACT | 5' UTR 1 | 3' UTR 2 | 291 |

TABLE 6-continued

DNA Sequences

| Name | ORF Sequence | 5' UTR | 3' UTR | SEQ ID NO: |
|---|---|---|---|---|
| | CTACAGTGCATTGGCTAATAAATGTTGCCATG<br>TTGGTTGTACCAAAAGATCTCTTGCTAGATTTT<br>GCGGCAGCACAGACTCCGGCTCTGATACCAGC<br>TCCGGCAACAGCGGCGATGGCAATTCCGGCG<br>GCAGCTCCGGAGGAGGCTCTGGCTCTAGCTCC<br>GGCTCTAGCGGCAGCGGCGGCTCCGGCGGCA<br>GCACAGACTCCGGCTCTGATACCAGCTCCGGC<br>AACAGCGGCGATGGCAATTCCGGCGGCAGCT<br>CCGGAGGAGGCTCTGGCTCTAGCTCCGGCTCT<br>AGCGGCAGCGGCGGCTCCGGCGAGCCCAAGA<br>GCAGCGACAAGACCCACACCAGCCCCCCCAG<br>CCCCGCCCCCGAGCTGCTGGGCGGCAGCAGC<br>GTGTTCCTGTTCCCCCCCAAGCCCAAGGACAC<br>CCTGTACATCACCAGGGAGCCCGAGGTGACCT<br>GCGTGGTGGTGGACGTGAGCCACGAGGACCC<br>CGAGGTGAAGTTCAACTGGTACGTGGACGGC<br>GTGGAGGTGCACAACGCCAAGACCAAGCCCA<br>GGGAGGAGCAGTACAACAGCACCTACAGGGT<br>GGTGAGCGTGCTGACCGTGCTGCACCAGGACT<br>GGCTGAACGGCAAGGAGTACAAGTGCAAGGT<br>GAGCAACAAGGCCCTGCCCGCCCCCATCGAG<br>AAGACCATCAGCAAGGCCAAGGGCCAGCCCA<br>GGGAGCCCCAGGTGTACACCCTGCCCCCCAGC<br>AGGGACGAGCTGACCAAGAACCAGGTGAGCC<br>TGACCTGCCTGGTGAAGGGCTTCTACCCCAGC<br>GACATCGCCGTGGAGTGGGAGAGCAACGGCC<br>AGCCCGAGAACAACTACAAGACCACCCCCCC<br>CGTGCTGGACAGCGACGGCAGCTTCTTCCTGT<br>ACAGCAAGCTGACCGTGGACAAGAGCAGGTG<br>GCAGCAGGGCAACGTGTTCAGCTGCAGCGTG<br>ATGCACGAGGCCCTGCACAACCACTACACCCA<br>GAAGAGCCTGAGCCTGAGCCCCGGCAAGAGG<br>AAG | | | |
| Construct 130 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCGG<br>CAGCACAGACTCCGGCTCTGATACCAGCTCCG<br>GCAACAGCGGCGATGGCAATTCCGGCCAACT<br>CTACAGTGCATTGGCTAATAAATGTTGCCATG<br>TTGGTTGTACCAAAAGATCTCTTGCTAGATTTT<br>GCGAGCCCAAGAGCAGCGACAAGACCCACAC<br>CAGCCCCCCAGCCCCGCCCCCGAGCTGCTGG<br>GCGGCAGCAGCGTGTTCCTGTTCCCCCCCAAG<br>CCCAAGGACACCCTGTACATCACCAGGGAGC<br>CCGAGGTGACCTGCGTGGTGGTGGACGTGAG<br>CCACGAGGACCCCGAGGTGAAGTTCAACTGG<br>TACGTGGACGGCGTGGAGGTGCACAACGCCA<br>AGACCAAGCCCAGGGAGGAGCAGTACAACAG<br>CACCTACAGGGTGGTGAGCGTGCTGACCGTGC<br>TGCACCAGGACTGGCTGAACGGCAAGGAGTA<br>CAAGTGCAAGGTGAGCAACAAGGCCCTGCCC<br>GCCCCCATCGAGAAGACCATCAGCAAGGCCA<br>AGGGCCAGCCCAGGGAGCCCCAGGTGTACAC<br>CCTGCCCCCCAGCAGGGACGAGCTGACCAAG<br>AACCAGGTGAGCCTGACCTGCCTGGTGAAGG<br>GCTTCTACCCCAGCGACATCGCCGTGGAGTGG<br>GAGAGCAACGGCCAGCCCGAGAACAACTACA<br>AGACCACCCCCCCCGTGCTGGACAGCGACGG<br>CAGCTTCTTCCTGTACAGCAAGCTGACCGTGG<br>ACAAGAGCAGGTGGCAGCAGGGCAACGTGTT<br>CAGCTGCAGCGTGATGCACGAGGCCCTGCAC<br>AACCACTACACCCAGAAGAGCCTGAGCCTGA<br>GCCCCGGCAAGAGGAAG | 5' UTR 1 | 3' UTR 2 | 292 |
| Construct 131 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCGG<br>CAGCACAGACTCCGGCTCTGATACCAGCTCCG<br>GCAACAGCGGCGATGGCAATTCCGGCCAACT | 5' UTR 1 | 3' UTR 2 | 293 |

TABLE 6-continued

DNA Sequences

| Name | ORF Sequence | 5' UTR | 3' UTR | SEQ ID NO: |
|---|---|---|---|---|
| | CTACAGTGCATTGGCTAATAAATGTTGCCATG<br>TTGGTTGTACCAAAAGATCTCTTGCTAGATTTT<br>GCGGCAGCACAGACTCCGGCTCTGATACCAGC<br>TCCGGCAACAGCGGCGATGGCAATTCCGGCG<br>AGCCCAAGAGCAGCGACAAGACCCACACCAG<br>CCCCCCCAGCCCCGCCCCCGAGCTGCTGGGCG<br>GCAGCAGCGTGTTCCTGTTCCCCCCCAAGCCC<br>AAGGACACCCTGTACATCACCAGGGAGCCCG<br>AGGTGACCTGCGTGGTGGTGGACGTGAGCCA<br>CGAGGACCCCGAGGTGAAGTTCAACTGGTAC<br>GTGGACGGCGTGGAGGTGCACAACGCCAAGA<br>CCAAGCCCAGGGAGGAGCAGTACAACAGCAC<br>CTACAGGGTGGTGAGCGTGCTGACCGTGCTGC<br>ACCAGGACTGGCTGAACGGCAAGGAGTACAA<br>GTGCAAGGTGAGCAACAAGGCCCTGCCCGCC<br>CCCATCGAGAAGACCATCAGCAAGGCCAAGG<br>GCCAGCCCAGGGAGCCCCAGGTGTACACCCT<br>GCCCCCCAGCAGGGACGAGCTGACCAAGAAC<br>CAGGTGAGCCTGACCTGCCTGGTGAAGGGCTT<br>CTACCCCAGCGACATCGCCGTGGAGTGGGAG<br>AGCAACGGCCAGCCCGAGAACAACTACAAGA<br>CCACCCCCCCCGTGCTGGACAGCGACGGCAGC<br>TTCTTCCTGTACAGCAAGCTGACCGTGGACAA<br>GAGCAGGTGGCAGCAGGGCAACGTGTTCAGC<br>TGCAGCGTGATGCACGAGGCCCTGCACAACC<br>ACTACACCCAGAAGAGCCTGAGCCTGAGCCC<br>CGGCAAGAGGAAG | | | |
| Construct 132 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GACAACTCTACAGTGCATTGGCTAATAAATGT<br>TGCCATGTTGGTTGTACCAAAAGATCTCTTGC<br>TAGATTTTGCGGCAGCACAGACTCCGGCTCTG<br>ATACCAGCTCCGGCAACAGCGGCGATGGCAA<br>TTCCGGCGAGCCCAAGAGCAGCGACAAGACC<br>CACACCAGCCCCCCCAGCCCCGCCCCCGAGCT<br>GCTGGGCGGCAGCAGCGTGTTCCTGTTCCCCC<br>CCAAGCCCAAGGACACCCTGTACATCACCAG<br>GGAGCCCGAGGTGACCTGCGTGGTGGTGGAC<br>GTGAGCCACGAGGACCCCGAGGTGAAGTTCA<br>ACTGGTACGTGGACGGCGTGGAGGTGCACAA<br>CGCCAAGACCAAGCCCAGGGAGGAGCAGTAC<br>AACAGCACCTACAGGGTGGTGAGCGTGCTGA<br>CCGTGCTGCACCAGGACTGGCTGAACGGCAA<br>GGAGTACAAGTGCAAGGTGAGCAACAAGGCC<br>CTGCCCGCCCCCATCGAGAAGACCATCAGCAA<br>GGCCAAGGGCCAGCCCAGGGAGCCCCAGGTG<br>TACACCCTGCCCCCCAGCAGGGACGAGCTGAC<br>CAAGAACCAGGTGAGCCTGACCTGCCTGGTG<br>AAGGGCTTCTACCCCAGCGACATCGCCGTGGA<br>GTGGGAGAGCAACGGCCAGCCCGAGAACAAC<br>TACAAGACCACCCCCCCCGTGCTGGACAGCGA<br>CGGCAGCTTCTTCCTGTACAGCAAGCTGACCG<br>TGGACAAGAGCAGGTGGCAGCAGGGCAACGT<br>GTTCAGCTGCAGCGTGATGCACGAGGCCCTGC<br>ACAACCACTACACCCAGAAGAGCCTGAGCCT<br>GAGCCCCGGCAAGAGGAAG | 5' UTR 1 | 3' UTR 2 | 294 |
| Construct 133 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA | 5' UTR 1 | 3' UTR 2 | 295 |

TABLE 6-continued

DNA Sequences

| Name | ORF Sequence | 5' UTR | 3' UTR | SEQ ID NO: |
|---|---|---|---|---|
| | AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GAGAGCCCAAGAGCAGCGACAAGACCCACAC<br>CAGCCCCCCAGCCCCGCCCCGAGCTGCTGG<br>GCGGCAGCAGCGTGTTCCTGTTCCCCCCCAAG<br>CCCAAGGACACCCTGTACATCACCAGGGAGC<br>CCGAGGTGACCTGCGTGGTGGTGGACGTGAG<br>CCACGAGGACCCCGAGGTGAAGTTCAACTGG<br>TACGTGGACGGCGTGGAGGTGCACAACGCCA<br>AGACCAAGCCCAGGGAGGAGCAGTACAACAG<br>CACCTACAGGGTGGTGAGCGTGCTGACCGTGC<br>TGCACCAGGACTGGCTGAACGGCAAGGAGTA<br>CAAGTGCAAGGTGAGCAACAAGGCCCTGCCC<br>GCCCCCATCGAGAAGACCATCAGCAAGGCCA<br>AGGGCCAGCCCAGGGAGCCCCAGGTGTACAC<br>CAAGCCCCCCAGCAGGGACGAGCTGACCAAG<br>AACCAGGTGAGCCTGTCCTGCCTGGTGAAGGG<br>CTTCTACCCCAGCGACATCGCCGTGGAGTGGG<br>AGAGCAACGGCCAGCCCGAGAACAACTACAA<br>GACCACCGTCCCCGTGCTGGACAGCGACGGC<br>AGCTTCCGCCTGGCCAGCTATCTGACCGTGGA<br>CAAGAGCAGGTGGCAGCAGGGCAACGTGTTC<br>AGCTGCAGCGTGATGCACGAGGCCCTGCACA<br>ACCACTACACCCAGAAGAGCCTGAGCCTGAG<br>CCCCGGCAAGAGGAAGGGCAGCACAGACTCC<br>GGCTCTGATACCAGCTCCGGCAACAGCGGCG<br>ATGGCAATTCCGGCCAACTCTACAGTGCATTG<br>GCTAATAAATGTTGCCATGTTGGTTGTACCAA<br>AAGATCTCTTGCTAGATTTTGC | | | |
| Construct 134 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GAGAGGTGCAGCTGCTGGAGAGCGGCGGCGG<br>CCTGGTGCAGCCCGGCGGCAGCCTGAGGCTG<br>AGCTGCGCCGCCAGCGGCTTCACCTTCAGCAG<br>CTACGCCATGAGCTGGGTGAGGCAGGCCCCC<br>GGCAAGGGCCTGGAGTGGGTGAGCGCCATCA<br>GCGGCAGCGGCGGCAGCACCTACTACGCCGA<br>CAGCGTGAAGGGCAGGTTCACCATCAGCAGG<br>GACAACAGCAAGAACACCCTGTACCTGCAGA<br>TGAACAGCCTGAGGGCCGAGGACACCGCCGT<br>GTACTACTGCACCAAGGACCCCCCCAGGTACC<br>ACTACACCGGCCTGGCCGTGAGGGGCCAGGG<br>CACCACCGTGACCGTGAGCAGCGGCAGCACA<br>GACTCCGGCTCTGATACCAGCTCCGGCAACAG<br>CGGCGATGGCAATTCCGGCCAACTCTACAGTG<br>CATTGGCTAATAAATGTTGCCATGTTGGTTGT<br>ACCAAAAGATCTCTTGCTAGATTTTGC | 5' UTR 1 | 3' UTR 2 | 296 |
| Construct 135 | ATGCCTCGCCTGTTTTTTTTCCACCTGCTAGGA<br>GTCTGTTTACTACTGAACCAATTTTCCAGAGC | 5' UTR 1 | 3' UTR 2 | 297 |

TABLE 6-continued

DNA Sequences

| Name | ORF Sequence | 5' UTR | 3' UTR | SEQ ID NO: |
|---|---|---|---|---|
| | AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GAGAGCCCAAGAGCAGCGACAAGACCCACAC<br>CAGCCCCCCCAGCCCCGCCCCGAGCTGCTGG<br>GCGGCAGCAGCGTGTTCCTGTTCCCCCCCAAG<br>CCCAAGGACACCCTGTACATCACCAGGGAGC<br>CCGAGGTGACCTGCGTGGTGGTGGACGTGAG<br>CCACGAGGACCCCGAGGTGAAGTTCAACTGG<br>TACGTGGACGGCGTGGAGGTGCACAACGCCA<br>AGACCAAGCCCAGGGAGGAGCAGTACAACAG<br>CACCTACAGGGTGGTGAGCGTGCTGACCGTGC<br>TGCACCAGGACTGGCTGAACGGCAAGGAGTA<br>CAAGTGCAAGGTGAGCAACAAGGCCCTGCCC<br>GCCCCCATCGAGAAGACCATCAGCAAGGCCA<br>AGGGCCAGCCCAGGGAGCCCCAGGTGTACAC<br>CCTGCCCCCCAGCAGGGACGAGCTGACCAAG<br>AACCAGGTGAGCCTGACCTGCCTGGTGAAGG<br>GCTTCTACCCCAGCGACATCGCCGTGGAGTGG<br>GAGAGCAACGGCCAGCCCGAGAACAACTACA<br>AGACCACCCCCCCCGTGCTGGACAGCGACGG<br>CAGCTTCTTCCTGTACAGCAAGCTGACCGTGG<br>ACAAGAGCAGGTGGCAGCAGGGCAACGTGTT<br>CAGCTGCAGCGTGATGCACGAGGCCCTGCAC<br>AACCACTACACCCAGAAGAGCCTGAGCCTGA<br>GCCCCGGCAAGAGGAAGGGCAGCACAGACTC<br>CGGCTCTGATACCAGCTCCGGCAACAGCGGCG<br>ATGGCAATTCCGGCCAACTCTACAGTGCATTG<br>GCTAATAAATGTTGCCATGTTGGTTGTACCAA<br>AAGATCTCTTGCTAGATTTTGC | | | |
| Construct<br>136 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GACAACTCTACAGTGCATTGGCTAATAAATGT<br>TGCCATGTTGGTTGTACCAAAAGATCTCTTGC<br>TAGATTTTGCGGCAGCACAGACTCCGGCTCTG<br>ATACCAGCTCCGGCAACAGCGGCGATGGCAA<br>TTCCGGCGAGCCCAAGAGCAGCGACAAGACC<br>CACACCAGCCCCCCAGCCCCGCCCCGAGCT<br>GCTGGGCGGCAGCAGCGTGTTCCTGTTCCCCC<br>CCAAGCCCAAGGACACCCTGTACATCACCAG<br>GGAGCCCGAGGTGACCTGCGTGGTGGTGGAC<br>GTGAGCCACGAGGACCCCGAGGTGAAGTTCA<br>ACTGGTACGTGGACGGCGTGGAGGTGCACAA<br>CGCCAAGACCAAGCCCAGGGAGGAGCAGTAC<br>AACAGCACCTACAGGGTGGTGAGCGTGCTGA<br>CCGTGCTGCACCAGGACTGGCTGAACGGCAA<br>GGAGTACAAGTGCAAGGTGAGCAACAAGGCC<br>CTGCCCGCCCCCATCGAGAAGACCATCAGCAA<br>GGCCAAGGGCCAGCCCAGGGAGCCCCAGGTG<br>TACACCAAGCCCCCCAGCAGGGACGAGCTGA | 5' UTR 1 | 3' UTR 2 | 298 |

TABLE 6-continued

DNA Sequences

| Name | ORF Sequence | 5' UTR | 3' UTR | SEQ ID NO: |
|---|---|---|---|---|
| | CCAAGAACCAGGTGAGCCTGTCCTGCCTGGTG<br>AAGGGCTTCTACCCCAGCGACATCGCCGTGGA<br>GTGGGAGAGCAACGGCCAGCCCGAGAACAAC<br>TACAAGACCACCGTCCCCGTGCTGGACAGCGA<br>CGGCAGCTTCCGCCTGGCCAGCTATCTGACCG<br>TGGACAAGAGCAGGTGGCAGCAGGGCAACGT<br>GTTCAGCTGCAGCGTGATGCACGAGGCCCTGC<br>ACAACCACTACACCCAGAAGAGCCTGAGCCT<br>GAGCCCCGGCAAGAGGAAG | | | |
| Construct 137 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GACAACTCTACAGTGCATTGGCTAATAAATGT<br>TGCCATGTTGGTTGTACCAAAAGATCTCTTGC<br>TAGATTTTGCGGCAGCACAGACTCCGGCTCTG<br>ATACCAGCTCCGGCAACAGCGGCGATGGCAA<br>TTCCGGCGAGGTGCAGCTGCTGGAGAGCGGC<br>GGCGGCCTGGTGCAGCCCGGCGGCAGCCTGA<br>GGCTGAGCTGCGCCGCCAGCGGCTTCACCTTC<br>AGCAGCTACGCCATGAGCTGGGTGAGGCAGG<br>CCCCCGGCAAGGGCCTGGAGTGGGTGAGCGC<br>CATCAGCGGCAGCGGCGGCAGCACCTACTAC<br>GCCGACAGCGTGAAGGGCAGGTTCACCATCA<br>GCAGGGACAACAGCAAGAACACCCTGTACCT<br>GCAGATGAACAGCCTGAGGGCCGAGGACACC<br>GCCGTGTACTACTGCACCAAGGACCCCCCCAG<br>GTACCACTACACCGGCCTGGCCGTGAGGGGCC<br>AGGGCACCACCGTGACCGTGAGCAGC | 5' UTR 1 | 3' UTR 2 | 299 |
| Construct 138 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCGG<br>CAGCACAGACTCCGGCTCTGATACCAGCTCCG<br>GCAACAGCGGCGATGGCAATTCCGGCGAGCC<br>CAAGAGCAGCGACAAGACCCACACCAGCCCC<br>CCCAGCCCCGCCCCCGAGCTGCTGGGCGGCAG<br>CAGCGTGTTCCTGTTCCCCCCCAAGCCCAAGG<br>ACACCCTGTACATCACCAGGGAGCCCGAGGT<br>GACCTGCGTGGTGGTGGACGTGAGCCACGAG<br>GACCCCGAGGTGAAGTTCAACTGGTACGTGG<br>ACGGCGTGGAGGTGCACAACGCCAAGACCAA<br>GCCCAGGGAGGAGCAGTACAACAGCACCTAC<br>AGGGTGGTGAGCGTGCTGACCGTGCTGCACCA<br>GGACTGGCTGAACGGCAAGGAGTACAAGTGC<br>AAGGTGAGCAACAAGGCCCTGCCCGCCCCCA<br>TCGAGAAGACCATCAGCAAGGCCAAGGGCCA<br>GCCCAGGGAGCCCCAGGTGTACACCAAGCCC<br>CCCAGCAGGGACGAGCTGACCAAGAACCAGG<br>TGAGCCTGTCCTGCCTGGTGAAGGGCTTCTAC<br>CCCAGCGACATCGCCGTGGAGTGGGAGAGCA<br>ACGGCCAGCCCGAGAACAACTACAAGACCAC<br>CGTCCCCGTGCTGGACAGCGACGGCAGCTTCC<br>GCCTGGCCAGCTATCTGACCGTGGACAAGAGC<br>AGGTGGCAGCAGGGCAACGTGTTCAGCTGCA<br>GCGTGATGCACGAGGCCCTGCACAACCACTAC<br>ACCCAGAAGAGCCTGAGCCTGAGCCCCGGCA<br>AGAGGAAGAAAAGGTCTCTGAGCCAGGAAGA<br>TGCTCCTCAGACACCTAGACCAGTGGCAGAAA<br>TTGTGCCATCCTTCATCAACAAAGATACAGAA | 5' UTR 1 | 3' UTR 2 | 300 |

TABLE 6-continued

DNA Sequences

| Name | ORF Sequence | 5' UTR | 3' UTR | SEQ ID NO: |
|---|---|---|---|---|
| | ACCATAAATATGATGTCAGAATTTGTTGCTAA TTTGCCACAGGAGCTGAAGTTAACCCTGTCTG AGATGCAGCCAGCATTACCACAGCTACAACA ACATGTACCTGTATTAAAAGATTCCAGTCTTC TCTTTGAAGAATTTAAGAAACTTATTCGCAAT AGACAAAGTGAAGCCGCAGACAGCAGTCCTT CAGAATTAAAATACTTAGGCTTGGATACTCAT TCTCGAAAAAGAGACAACTCTACAGTGCATT GGCTAATAAATGTTGCCATGTTGGTTGTACCA AAAGATCTCTTGCTAGATTTTGC | | | |
| Construct 139 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCGG CAGCACAGACTCCGGCTCTGATACCAGCTCCG GCAACAGCGGCGATGGCAATTCCGGCCAACT CTACAGTGCATTGGCTAATAAATGTTGCCATG TTGGTTGTACCAAAAGATCTCTTGCTAGATTTT GCGGCAGCACAGACTCCGGCTCTGATACCAGC TCCGGCAACAGCGGCGATGGCAATTCCGGCG AGGTGCAGCTGCTGGAGAGCGGCGGCGGCCT GGTGCAGCCCGGCGGCAGCCTGAGGCTGAGC TGCGCCGCCAGCGGCTTCACCTTCAGCAGCTA CGCCATGAGCTGGGTGAGGCAGGCCCCCGGC AAGGGCCTGGAGTGGGTGAGCGCCATCAGCG GCAGCGGCGGCAGCACCTACTACGCCGACAG CGTGAAGGGCAGGTTCACCATCAGCAGGGAC AACAGCAAGAACACCCTGTACCTGCAGATGA ACAGCCTGAGGGCCGAGGACACCGCCGTGTA CTACTGCACCAAGGACCCCCCCAGGTACCACT ACACCGGCCTGGCCGTGAGGGGCCAGGGCAC CACCGTGACCGTGAGCAGC | 5' UTR 1 | 3' UTR 2 | 301 |
| Construct 140 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCGG CAGCACAGACTCCGGCTCTGATACCAGCTCCG GCAACAGCGGCGATGGCAATTCCGGCCAACT CTACAGTGCATTGGCTAATAAATGTTGCCATG TTGGTTGTACCAAAAGATCTCTTGCTAGATTTT GCGGCAGCACAGACTCCGGCTCTGATACCAGC TCCGGCAACAGCGGCGATGGCAATTCCGGCG AGCCCAAGAGCAGCGACAAGACCCACACCAG CCCCCCCAGCCCCGCCCCCGAGCTGCTGGGCG GCAGCAGCGTGTTCCTGTTCCCCCCCAAGCCC AAGGACACCCTGTACATCACCAGGGAGCCCG AGGTGACCTGCGTGGTGGTGGACGTGAGCCA CGAGGACCCCGAGGTGAAGTTCAACTGGTAC GTGGACGGCGTGGAGGTGCACAACGCCAAGA CCAAGCCCAGGGAGGAGCAGTACAACAGCAC CTACAGGGTGGTGAGCGTGCTGACCGTGCTGC ACCAGGACTGGCTGAACGGCAAGGAGTACAA GTGCAAGGTGAGCAACAAGGCCCTGCCCGCC CCCATCGAGAAGACCATCAGCAAGGCCAAGG GCCAGCCCAGGGAGCCCCAGGTGTACACCAA GCCCCCCAGCAGGGACGAGCTGACCAAGAAC CAGGTGAGCCTGTCCTGCCTGGTGAAGGGCTT CTACCCCAGCGACATCGCCGTGGAGTGGGAG AGCAACGGCCAGCCCGAGAACAACTACAAGA CCACCGTCCCCGTGCTGGACAGCGACGGCAGC TTCCGCCTGGCCAGCTATCTGACCGTGGACAA GAGCAGGTGGCAGCAGGGCAACGTGTTCAGC TGCAGCGTGATGCACGAGGCCCTGCACAACC ACTACACCCAGAAGAGCCTGAGCCTGAGCCC CGGCAAGAGGGAAG | 5' UTR 1 | 3' UTR 2 | 302 |
| Construct 141 | ATGCCCCGGCTGTTCTTCTTCCACCTGCTGGGC GTGTGCCTCCTGCTGAACCAGTTCAGCAGGGC CGTGGCCGACAGCTGGATGGAGGAGGTGATC AAGCTGTGCGGCAGGGAGCTGGTGAGGGCGC | 5' UTR 1 | 3' UTR 1 | 303 |

TABLE 6-continued

| | DNA Sequences | | | |
|---|---|---|---|---|
| Name | ORF Sequence | 5' UTR | 3' UTR | SEQ ID NO: |
| | AGATCGCCATCTGCGGCATGAGCACCTGGAGC<br>AAGAGGAGCCTGAGCCAGGAGGACGCCCCGC<br>AAACCCCCCGGCCGGTCGCGGAGATAGTGCC<br>CAGCTTCATAAACAAGGACACCGAGACCATC<br>AATATGATGAGCGAGTTCGTGGCCAACCTGCC<br>CCAGGAGCTGAAGCTGACGCTGAGCGAGATG<br>CAGCCGGCCCTGCCGCAGCTGCAGCAGCACGT<br>GCCCGTGCTGAAGGACAGCAGCCTCCTGTTCG<br>AGGAGTTCAAGAAGCTGATCAGGAACCGGCA<br>GAGCGAGGCCGCCGACTCCAGCCCCAGCGAG<br>CTGAAGTACCTGGGCCTGGACACCCATAGCAG<br>GAAGAAGCGCCAGCTGTACAGCGCCCTGGCT<br>AACAAGTGCTGCCACGTGGGCTGCACCAAGA<br>GGAGCCTGGCCCGGTTCTGC | | | |
| Construct 142 | ATGCCCCGCCTCTTCTTCTTCCACCTCCTCGGC<br>GTGTGCCTCCTACTCAACCAGTTTAGCAGGGC<br>CGTGGCCGATAGCTGGATGGAGGAGGTGATC<br>AAGCTCTGCGGCAGAGAGCTCGTGCGGGCCC<br>AGATCGCCATCTGCGGCATGAGCACCTGGAGC<br>AAGAGGAGCCTGAGCCAGGAGGACGCCCCAC<br>AAACCCCGCGCCCCGTGGCCGAGATCGTGCCC<br>AGCTTCATCAACAAGGACACCGAAACCATCA<br>ACATGATGAGCGAGTTTGTCGCCAACCTGCCC<br>CAGGAGCTCAAGCTGACCCTGAGCGAGATGC<br>AGCCCGCCCTGCCTCAGCTGCAGCAGCACGTG<br>CCAGTGCTGAAAGACTCCAGCCTGCTCTTTGA<br>AGAGTTCAAGAAGCTGATCAGGAACAGACAG<br>AGCGAGGCCGCTGACAGCAGCCCCTCAGAGC<br>TGAAGTACCTGGGGCTGGATACCCATAGCCGC<br>AAGAAGCGGCAGCTGTACTCCGCCCTCGCCAA<br>CAAGTGCTGCCACGTGGGCTGCACCAAGCGG<br>AGCCTCGCCCGATTCTGTGGCGGCGGAGGGTC<br>CGGCGGCGGCGGCAGCGGTGGAGGCGGGAGC<br>GACATCCAGATGACCCAGAGCCCCAGCAGCC<br>TGTCCGCCAGTGTGGGCGATAGAGTCACCATC<br>ACGTGCAGGGCCTCCAGGCCCATCGGCACCAT<br>GCTGAGCTGGTACCAGCAGAAGCCCGGCAAG<br>GCGCCCAAGCTGCTGATCCTGGCCTTCAGCAG<br>GCTGCAGTCCGGGGTGCCCAGCCGGTTCTCCG<br>GCTCCGGCAGCGGCACCGACTTTACCCTGACC<br>ATCAGCAGCCTGCAGCCTGAGGACTTCGCCAC<br>CTACTACTGCGCCCAGGCCGGCACCCACCCCA<br>CCACGTTCGGTCAGGGCACTAAGGTGGAGATC<br>AAGCGG | 5' UTR 1 | 3' UTR 1 | 304 |
| Construct 143 | ATGCCCCGCCTCTTCTTCTTCCACCTCCTCGGC<br>GTGTGCCTCCTACTCAACCAGTTTAGCAGGGC<br>CGTGGCCGATAGCTGGATGGAGGAGGTGATC<br>AAGCTCTGCGGCAGAGAGCTCGTGCGGGCCC<br>AGATCGCCATCTGCGGCATGAGCACCTGGAGC<br>AAGAGGAGCCTGAGCCAGGAGGACGCCCCAC<br>AAACCCCGCGCCCGTGGCCGAGATCGTGCCC<br>AGCTTCATCAACAAGGACACCGAAACCATCA<br>ACATGATGAGCGAGTTTGTCGCCAACCTGCCC<br>CAGGAGCTCAAGCTGACCCTGAGCGAGATGC<br>AGCCCGCCCTGCCTCAGCTGCAGCAGCACGTG<br>CCAGTGCTGAAAGACTCCAGCCTGCTCTTTGA<br>AGAGTTCAAGAAGCTGATCAGGAACAGACAG<br>AGCGAGGCCGCTGACAGCAGCCCCTCAGAGC<br>TGAAGTACCTGGGGCTGGATACCCATAGCCGC<br>AAGAAGCGGCAGCTGTACTCCGCCCTCGCCAA<br>CAAGTGCTGCCACGTGGGCTGCACCAAGCGG<br>AGCCTCGCCCGATTCTGTGGCGGCGGAGGGTC<br>CGGCGGCGGCGGCAGCGGTGGAGGCGGGAGC<br>GACATCCAGATGACCCAGAGCCCCAGCAGCC<br>TGTCCGCCAGTGTGGGCGATAGAGTCACCATC<br>ACGTGCAGGGCCTCCAGGCCCATCGGCACCAT<br>GCTGAGCTGGTACCAGCAGAAGCCCGGCAAG<br>GCGCCCAAGCTGCTGATCCTGGCCTTCAGCAG<br>GCTGCAGTCCGGGGTGCCCAGCCGGTTCTCCG<br>GCTCCGGCAGCGGCACCGACTTTACCCTGACC<br>ATCAGCAGCCTGCAGCCTGAGGACTTCGCCAC<br>CTACTACTGCGCCCAGGCCGGCACCCACCCCA | 5' UTR 1 | 3' UTR 1 | 305 |

TABLE 6-continued

| | DNA Sequences | | | |
|---|---|---|---|---|
| Name | ORF Sequence | 5' UTR | 3' UTR | SEQ ID NO: |
| | CCACGTTCGGTCAGGGCACTAAGGTGGAGATC AAGCGG | | | |
| Construct 144 | ATGCCCCGGCTGTTCTTCTTCCACCTACTCGGC GTCTGCCTCCTCCTAAACCAGTTTTCCCGCGCC GTGGCCGACTCCTGGATGGAGGAGGTGATCA AGCTCTGCGGCAGAGAGCTCGTGAGGGCCCA GATCGCGATTTGCGGCATGTCCACCTGGAGCA AGAGGAGCCTCAGCCAGGAGGACGCGCCCCA AACCCCGAGGCCCGTGGCCGAGATCGTGCCG AGCTTTATCAACAAGGACACCGAAACCATCA ACATGATGTCCGAGTTTGTGGCTAATCTGCCC CAGGAGCTCAAGCTCACACTGTCCGAGATGCA GCCCGCCCTGCCCCAACTGCAGCAGCACGTCC CCGTGCTCAAGGACAGCAGCCTCCTCTTCGAG GAATTCAAGAAGCTCATCCGCAACCGGCAGA GCGAGGCCGCCGACAGCAGCCCCTCAGAGCT GAAGTACCTGGGCCTCGACACCCACAGCCGG AAGAAGAGGCAGCTGTACTCCGCCCTGGCCA ACAAATGCTGCCATGTGGGCTGCACAAAGAG GAGCCTGGCCCGGTTTTGCGGAGGTGGTGGGA GCGGCGGTGGCGGTTCAGGCGGCGGCGGTTC CGACATCCAGATGACCCAGAGCCCCAGCAGC CTGTCCGCTTCCGTGGGCGACCGTGTGACCAT CACCTGCCGCGCCAGCCGACCCATCGGCACCA TGCTGTCCTGGTACCAGCAGAAGCCGGGGAA GGCCCCAAAGCTGCTGATTCTGGCCTTTAGCC GGCTGCAGAGCGGGGTGCCCAGCAGATTCAG CGGCTCGGGGAGCGGGACCGACTTTACGCTG ACCATCAGCTCCCTGCAGCCCGAGGATTTCGC AACGTACTACTGTGCCCAGGCCGGCACCCACC CCACTACTTTCGGCCAGGGCACCAAGGTGGAG ATCAAGCGT | 5' UTR 1 | 3' UTR 1 | 306 |
| Construct 145 | ATGCCCAGGCTGTTCTTCTTCCACCTCCTCGGC GTGTGTCTCCTCCTCAACCAGTTCAGCAGAGC CGTCGCCGATTCTTGGATGGAGGAGGTGATCA AGTTGTGCGGCCGGGAGCTCGTGAGGGCTCA GATCGCCATCTGCGGCATGTCAACCTGGAGCA AGCGGTCGCTGAGCCAGGAGGACGCCCCCTCA GACCCCGAGGCCCGTGGCCGAGATCGTGCCTA GCTTCATCAACAAGGACACCGAGACAATCAA CATGATGAGCGAGTTTGTGGCGAATCTGCCCC AGGAGCTGAAGCTCACCCTCAGCGAGATGCA GCCCGCCCTGCCCCAGCTGCAGCAGCACGTGC CCGTGCTGAAGGACAGCAGCCTGCTGTTCGAG GAGTTTAAGAAGCTGATCCGGAACAGGCAGA GCGAGGCCGCCGACAGCAGCCCCTCTGAACT GAAGTATCTCGGGCTGGACACCCACAGCCGG AAGAAGCGCCAGCTGTACTCCGCCCTGGCCAA CAAATGCTGCCACGTGGGGTGCACCAAACGG AGCCTGGCCCGGTTCTGTGGCGGCGGCGGCTC CGGCGGCGGTGGGTCTGGAGGCGGCGGCTCG GATATCCAGATGACCCAGAGCCCCAGCAGCCT GTCCGCCTCCGTGGGCGACAGGGTGACCATCA CCTGCCGGGCCTCTAGGCCCATCGGGACCATG CTCAGCTGGTACCAGCAGAAACCAGGCAAGG CCCCTAAGCTGCTGATCCTGGCATTCAGCCGC CTGCAGAGCGGCGTCCCCTCCAGGTTCAGCGG CAGCGGTAGCGGAACGGACTTCACCCTCACCA TTAGCTCCCTCCAGCCCGAGGACTTCGCCACC TACTACTGTGCACAGGCCGGTACCCACCCCAC GACCTTCGGCCAGGGCACAAAGGTGGAGATC AAGCGG | 5' UTR 1 | 3' UTR 1 | 307 |
| Construct 146 | ATGCCTAGGCTGTTCTTCTTCCACCTCCTCGGC GTGTGTCTCCTCCTCAACCAGTTCAGCCGGGC CGTGGCCGACTCCTGGATGGAGGAGGTGATC AAGCTCTGCGGCAGAGAGCTCGTCCGAGCCC AGATAGCCATCTGCGGCATGAGCACCTGGAG CAAGAGGAGCCTGAGTCAGGAGGACGCCCCT CAGACACCCCGGCCCGTGGCTGAGATCGTGCC CAGCTTCATTAACAAAGACACCGAAACCATCA ACATGATGTCCGAGTTCGTGGCCAATCTGCCA | 5' UTR 1 | 3' UTR 1 | 308 |

TABLE 6-continued

DNA Sequences

| Name | ORF Sequence | 5' UTR | 3' UTR | SEQ ID NO: |
|---|---|---|---|---|
| | CAGGAGCTCAAGCTGACCCTGAGCGAGATGC<br>AGCCCGCCCTGCCCCAGCTGCAGCAGCACGTG<br>CCCGTGCTGAAGGACAGCAGCCTGCTCTTTGA<br>GGAGTTCAAGAAGCTGATCCGCAACCGACAG<br>AGCGAGGCTGCCGATAGCAGCCCTTCCGAACT<br>CAAATACCTGGGCCTGGACACACACAGCCGG<br>AAGAAGCGGCAGCTGTACAGCGCCCTGGCTA<br>CAAGTGTTGCCACGTAGGGTGCACCAAACG<br>CAGCCTGGCCAGATTCTGCGGCGGCGGCGGCT<br>CCGGCGGAGGCGGATCAGGCGGCGGCGGCAG<br>CGATATCCAGATGACTCAGAGCCCCAGCTCCC<br>TGAGCGCCTCCGTTGGGGACCGGGTGACCATC<br>ACCTGCAGAGCGAGCCGCCCCATCGGCACCAT<br>GCTCTCCTGGTACCAACAGAAGCCAGGCAAG<br>GCCCCGAAGCTGCTGATTCTCGCCTTCAGCAG<br>GCTGCAAAGCGGCGTGCCCAGCAGGTTCTCCG<br>GCTCCGGCAGCGGCACAGACTTCACCCTGACC<br>ATCAGCTCCCTGCAGCCGGAGGACTTCGCCAC<br>CTACTATTGTGCCCAGGCCGGCACCCACCCCA<br>CCACCTTCGGCCAAGGCACAAAGGTGGAAAT<br>CAAGAGG | | | |
| Construct 147 | ATGCCCAGACTCTTCTTCTTCCATCTACTCGGT<br>GTGTGTCTCCTCCTCAATCAGTTTAGCCGGGC<br>CGTTGCCGACAGCTGGATGGAGGAGGTCATC<br>AAGCTCTGCGGCAGGGAGCTCGTGCGGGCCC<br>AGATCGCCATCTGCGGCATGAGCACCTGGAGC<br>AAGAGATCCCTGTCGCAGGAGGACGCGCCAC<br>AGACTCCTCGGCCCGTGGCCGAGATCGTGCCC<br>AGCTTTATCAACAAGGACACCGAAACCATCA<br>ACATGATGAGCGAGTTCGTGGCAAATCTGCCC<br>CAGGAGCTGAAGCTGACCCTGAGCGAGATGC<br>AGCCTGCCTTGCCTCAGCTGCAGCAGCATGTG<br>CCCGTGCTCAAAGATAGCAGCCTGCTGTTCGA<br>GGAGTTCAAGAAACTGATCCGGAACCGGCAG<br>AGCGAGGCCGCCGACTCCAGCCCCTCTGAGCT<br>GAAGTACCTGGGGCTGGACACGCACTCCCGG<br>AAGAAGAGACAGCTCTATAGCGCCCTGGCCA<br>ACAAGTGCTGTCATGTGGGATGCACCAAGAG<br>AAGCCTCGCCCGCTTCTGCGGAGGCGGAGGC<br>AGCGGCGGTGGCGGTAGCGGAGGCGGCGGGT<br>CCGACATACAGATGACCCAGAGCCCCTCCTCC<br>CTGAGTGCCTCCGTCGGCGACCGGGTGACCAT<br>CACGTGCCGCGCCAGCCGGCCCATCGGCACA<br>ATGCTGTCCTGGTACCAGCAGAAGCCCGGGA<br>AGGCGCCCAAGCTGCTGATCCTGGCGTTCTCC<br>CGGCTGCAGTCCGGCGTGCCCAGCAGGTTCAG<br>CGGCTCAGGCTCCGGTACCGACTTCACCCTGA<br>CTATAAGCAGCCTGCAGCCGGAGGATTTTGCC<br>ACCTACTACTGCGCCCAGGCCGGCACCCACCC<br>AACCACCTTCGGCCAGGGCACCAAGGTGGAG<br>ATCAAGCGG | 5' UTR 1 | 3' UTR 1 | 309 |
| Construct 148 | ATGCCCAGGCTGTTCTTCTTCCACCTCCTCGGC<br>GTGTGCCTCCTCCTCAACCAGTTCAGCCGGGC<br>CGTGGCCGACAGCTGGATGGAGGAGGTGATC<br>AAGCTCTGCGGCCGGGAGCTCGTGCGGGCCC<br>AGATCGCCATCTGCGGCATGAGCACCTGGAGC<br>AAGCGGAGCCTGAGCCAGGAGGACGCCCCGC<br>AGACTCCGCGGCCAGTGGCCGAGATCGTGCCC<br>AGCTTCATCAACAAGGACACCGAAACCATCA<br>ACATGATGAGCGAGTTCGTGGCCAACCTGCCC<br>CAGGAGCTGAAGCTGACCCTGAGCGAGATGC<br>AGCCCGCTCTGCCGCAGCTGCAGCAGCACGTG<br>CCCGTGCTGAAGGACAGCAGCCTGCTGTTCGA<br>GGAGTTCAAGAAGCTGATCCGGAACCGGCAG<br>AGCGAGGCCGCAGATTCTTCTCCTAGCGAGCT<br>CAAGTACCTGGGCCTGGACACCCACAGCCGG<br>AAGAAGCGGCAGCTGTACAGCGCCCTGGCCA<br>ACAAGTGCTGCCACGTGGGCTGCACCAAGAG<br>GTCACTGGCCCGGTTCTGCGGCGGCGGTGGAT<br>CTGGCGGAGGAGGCTCGGGAGGCGGCGGCAG<br>CGACATCCAGATGACCCAGAGCCCAAGCTCCC<br>TGTCCGCCAGCGTGGGCGACCGGGTGACCATC | 5' UTR 1 | 3' UTR 1 | 310 |

TABLE 6-continued

DNA Sequences

| Name | ORF Sequence | 5' UTR | 3' UTR | SEQ ID NO: |
|---|---|---|---|---|
| | ACCTGCCGGGCCAGCCGGCCCATCGGCACCAT<br>GCTGAGCTGGTACCAGCAGAAGCCCGGCAAG<br>GCCCCGAAGCTGCTGATCCTGGCCTTCTCTAG<br>GCTGCAGAGCGGCGTGCCGAGCCGGTTCTCGG<br>GCAGCGGCTCCGGCACCGACTTCACCCTGACT<br>ATCTCGAGCCTCCAGCCGGAGGACTTCGCCAC<br>CTACTACTGCGCCCAGGCCGGCACCCACCCCA<br>CCACCTTCGGCCAGGGCACCAAGGTGGAGAT<br>CAAGCGG | | | |
| Construct 149 | ATGCCCAGGCTGTTCTTCTTCCACCTCCTCGGC<br>GTGTGCCTCCTCCTAAACCAGTTCAGCCGGGC<br>CGTGGCCGACAGCTGGATGGAGGAGGTGATC<br>AAGCTCTGCGGCCGGGAGCTCGTGCGGGCCC<br>AGATCGCCATCTGCGGCATGAGCACCTGGAGC<br>AAGCGGAGCCTGAGCCAGGAGGACGCCCCTC<br>AGACGCCACGGCCGGTGGCCGAGATCGTGCC<br>CAGCTTCATCAACAAGGACACCGAGACAATC<br>AACATGATGAGCGAGTTCGTGGCCAACCTGCC<br>CCAGGAGCTGAAGCTGACCCTGAGCGAGATG<br>CAGCCCGCCCTGCCGCAGCTGCAGCAGCACGT<br>GCCCGTGCTGAAGGACAGCAGCCTGCTGTTCG<br>AGGAGTTCAAGAAGCTGATCCGGAACCGGCA<br>GAGCGAGGCCGCCGACTCCAGCCCCAGCGAA<br>TTGAAGTACCTGGGCCTGGACACCCACAGCCG<br>GAAGAAGCGGCAGCTGTACAGCGCCCTGGCC<br>AACAAGTGCTGCCACGTGGGCTGCACCAAGA<br>GGAGTCTGGCCCGGTTCTGCGGCGGAGGCGG<br>AAGCGGTGGAGGCGGCTCTGGCGGCGGTGGC<br>TCGGACATCCAGATGACCCAGAGCCCGTCCTC<br>CCTGTCCGCAGCGTGGGCGACCGGGTGACCA<br>TCACCTGCCGGGCCAGCCGGCCCATCGGCACC<br>ATGCTGAGCTGGTACCAGCAGAAGCCCGGCA<br>AGGCCCCGAAGCTGCTGATCCTGGCCTTCAGC<br>AGGCTGCAGAGCGGCGTGCCGAGCCGGTTCA<br>GCGGTAGCGGCTCCGGCACCGACTTCACCCTG<br>ACAATCAGCTCGCTGCAGCCAGAGGACTTCGC<br>CACCTACTACTGCGCCCAGGCCGGCACCCACC<br>CCACCACCTTCGGCCAGGGCACCAAGGTGGA<br>GATCAAGCGG | 5' UTR 1 | 3' UTR 1 | 311 |
| Construct 150 | ATGCCCAGACTGTTCTTCTTCCACCTCTTGGGC<br>GTGTGCCTCCTCCTCAACCAGTTCAGCCGGGC<br>CGTGGCCGACAGCTGGATGGAGGAGGTCATC<br>AAGCTCTGCGGCCGCGAGCTCGTCCGCGCCCA<br>GATCGCCATCTGCGGCATGTCCACCTGGTCCA<br>AGCGCTCCCTCTCCCAGGAGGACGCTCCGCAG<br>ACCCCGCGCCCCGTCGCCGAGATCGTCCCCTC<br>CTTCATCAACAAGGACACCGAGACGATCAAC<br>ATGATGTCCGAGTTCGTCGCCAACCTCCCACA<br>GGAGCTCAAGCTCACCCTCTCCGAGATGCAGC<br>CCGCCCTGCCGCAGCTCCAGCAGCACGTCCCC<br>GTCCTCAAGGACTCCTCCCTCCTCTTCGAGGA<br>GTTCAAGAAGCTCATCCGCAACCGCCAGTCCG<br>AGGCCGCGGACAGCAGCCCGTCCGAGCTGAA<br>GTACCTCGGCCTCGACACCCACTCCCGCAAGA<br>AGCGCCAGCTCTACTCCGCCCTCGCCAACAAG<br>TGCTGCCACGTCGGCTGCACCAAGAGGAGCCT<br>GGCCCGCTTCTGCGGCGGAGGCGGCAGCGGC<br>GGCGGTGGATCCGGTGGCGGCGGAAGCGACA<br>TCCAGATGACCCAGAGCCCGAGCAGCCTGAG<br>CGCCTCCGTCGGCGACCGCGTCACCATCACCT<br>GCCGCGCCTCCCGCCCCATCGGCACCATGCTC<br>TCCTGGTACCAGCAGAAGCCCGGCAAGGCCC<br>CTAAGCTCCTCATCCTCGCCTTCTCCCGCCTCC<br>AGTCCGGCGTGCCGAGCCGGTTCTCCGGAAGC<br>GGCTCGGGCACCGACTTCACCCTCACCATCTC<br>CTCACTCCAGCCGGAGGACTTCGCCACCTACT<br>ACTGCGCCCAGGCCGGCACCCACCCCACCACC<br>TTCGGCCAGGGCACCAAGGTCGAGATCAAGC<br>GC | 5' UTR 1 | 3' UTR 1 | 312 |
| Construct 151 | ATGCCCAGACTGTTCTTCTTCCACCTCCTCGGC<br>GTGTGCCTCCTCCTCAACCAGTTCAGCCGGGC | 5' UTR 1 | 3' UTR 1 | 313 |

TABLE 6-continued

DNA Sequences

| Name | ORF Sequence | 5' UTR | 3' UTR | SEQ ID NO: |
|---|---|---|---|---|
| | CGTGGCCGACAGCTGGATGGAGGAGGTCATC<br>AAGCTCTGCGGCCGCGAGCTCGTCCGCGCCCA<br>GATCGCCATCTGCGGCATGTCCACCTGGTCCA<br>AGCGCTCCCTCTCCCAGGAGGACGCCCCGCAG<br>ACGCCGCGCCCCGTCGCCGAGATCGTCCCCTC<br>CTTCATCAACAAGGACACCGAGACAATCAAC<br>ATGATGTCCGAGTTCGTCGCCAACCTGCCGCA<br>GGAGCTCAAGCTCACCCTCTCCGAGATGCAGC<br>CCGCCCTGCCGCAACTCCAGCAGCACGTCCCC<br>GTCCTCAAGGACTCCTCCCTCCTCTTCGAGGA<br>GTTCAAGAAGCTCATCCGCAACCGCCAGTCCG<br>AGGCCGCCGACTCCAGCCCCTCCGAGCTGAAG<br>TACCTCGGCCTCGACACCCACTCCCGCAAGAA<br>GCGCCAGCTCTACTCCGCCCTCGCCAACAAGT<br>GCTGCCACGTCGGCTGCACCAAGCGGAGCCTG<br>GCCCGCTTCTGCGGCGGTGGCGGAAGCGGAG<br>GCGGAGGCAGCGGCGGAGGTGGCTCCGACAT<br>CCAGATGACCCAGAGCCCTAGCTCTCTGAGCG<br>CCTCCGTCGGCGACCGCGTCACCATCACCTGC<br>CGCGCCTCCCGCCCCATCGGCACCATGCTCTC<br>CTGGTACCAGCAGAAGCCCGGCAAGGCCCCG<br>AAGCTCCTCATCCTCGCCTTCTCCCGCCTCCAG<br>TCCGGCGTGCCGTCCCGGTTCAGCGGCTCCGG<br>CAGCGGAACCGACTTCACCCTGACGATCAGCT<br>CCCTGCAGCCTGAGGACTTCGCCACCTACTAC<br>TGCGCCCAGGCCGGCACCCACCCCACCACCTT<br>CGGCCAGGGCACCAAGGTCGAGATCAAGCGC | | | |
| Construct 152 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTGATC<br>AAGCTGTGCGGCCGGGAGCTGGTGCGGGCCC<br>AGATCGCCATCTGCGGCATGAGCACCTGGAGC<br>AAGCGGAGCCTGAGCCAGGAGGACGCACCCC<br>AGACCCCACGGCCCGTGGCCGAGATCGTGCCC<br>AGCTTCATCAACAAGGACACCGAGACCATCA<br>ACATGATGAGCGAGTTCGTGGCCAACCTGCCC<br>CAGGAGCTGAAGCTGACCCTGAGCGAGATGC<br>AGCCCGCCCTGCCCCAGCTGCAGCAGCACGTG<br>CCCGTGCTGAAGGACAGCAGCCTGCTGTTCGA<br>GGAGTTCAAGAAGCTGATCCGGAACCGGCAG<br>AGCGAGGCCGCCGACAGCAGCCCCAGCGAGC<br>TGAAGTACCTGGGCCTGGACACCCACAGCCG<br>GAAGAAGCGGCAGCTGTACAGCGCCCTGGCC<br>AACAAGTGCTGCCACGTGGGCTGCACCAAGC<br>GGAGCCTGGCCCGGTTCTGCGGCGGCGGCGG<br>CAGCGGCGGCGGCGGCAGCGGCGGCGGCGGC<br>AGCGACATCCAGATGACCCAGAGCCCCAGCA<br>GCCTGAGCGCCAGCGTGGGCGACCGGGTGAC<br>CATCACCTGCCGGGCCAGCCGGCCCATCGGCA<br>CCATGCTGAGCTGGTACCAGCAGAAGCCCGG<br>CAAGGCCCCCAAGCTGCTGATCCTGGCCTTCA<br>GCCGGCTGCAGAGCGGCGTGCCCAGCCGGTTC<br>AGCGGCAGCGGCAGCGGCACCGACTTCACCC<br>TGACCATCAGCAGCCTGCAGCCCGAGGACTTC<br>GCCACCTACTACTGCGCCCAGGCCGGCACCCA<br>CCCCACCACCTTCGGCCAGGGCACCAAGGTGG<br>AGATCAAGCGG | 5' UTR 1 | 3' UTR 1 | 314 |
| Construct 153 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTGATC<br>AAGCTGTGCGGGAGGGAGCTGGTGAGGGCGC<br>AGATCGCGATCTGCGGGATGAGCACGTGGAG<br>CAAGAGGAGCCTGAGCCAGGAGGACGCCG<br>CAGACGCCGAGGCCGGTGGCGGAGATCGTGC<br>CGAGCTTCATCAACAAGGACACGGAGACGAT<br>CAACATGATGAGCGAGTTCGTGGCGAACCTGC<br>CGCAGGAGCTGAAGCTGACGCTGAGCGAGAT<br>GCAGCCGGCGCTGCCGCAGCTGCAGCAGCAC<br>GTGCCGGTGCTGAAGGACAGCAGCCTGCTGTT<br>CGAGGAGTTCAAGAAGCTGATCAGGAACAGG<br>CAGAGCGAGGCGGCGGACAGCAGCCCGAGCG<br>AGCTGAAGTACCTGGGGCTGGACACGCACAG | 5' UTR 1 | 3' UTR 1 | 315 |

TABLE 6-continued

DNA Sequences

| Name | ORF Sequence | 5' UTR | 3' UTR | SEQ ID NO: |
|---|---|---|---|---|
| | CAGGAAGAAGAGGCAGCTGTACAGCGCGCTG<br>GCGAACAAGTGCTGCCACGTGGGGTGCACGA<br>AGAGGAGCCTGGCGAGGTTCTGCGGAGGCGG<br>TGGGAGCGGTGGCGGAGGGAGCGGCGGAGGC<br>GGGAGCGACATCCAGATGACGCAGAGCCCGA<br>GCAGCCTGAGCGCGAGCGTGGGGGACAGGGT<br>GACGATCACGTGCAGGGCGAGCAGGCCGATC<br>GGGACGATGCTGAGCTGGTACCAGCAGAAGC<br>CGGGGAAGGCGCCGAAGCTGCTGATCCTGGC<br>GTTCAGCAGGCTGCAGAGCGGGGTGCCGAGC<br>AGGTTCAGCGGGAGCGGGAGCGGGACGGACT<br>TCACGCTGACGATCAGCAGCCTGCAGCCGGA<br>GGACTTCGCGACGTACTACTGCGCGCAGGCGG<br>GGACGCACCCGACGACGTTCGGGCAGGGGAC<br>GAAGGTGGAGATCAAGAGG | | | |
| Construct 154 | ATGCCCCGGCTGTTCTTCTTCCACCTGCTGGGC<br>GTGTGCCTGCTGCTGAACCAGTTCAGCCGGGC<br>CGTGGCCGACAGCTGGATGGAGGAGGTCATC<br>AAGCTCTGCGGCCGCGAGCTCGTCCGCGCCCA<br>GATCGCCATCTGCGGCATGTCCACCTGGTCCA<br>AGCGCTCCCTCTCCCAGGAGGACGCACCCCAG<br>ACACCCCGCCCCGTCGCCGAGATCGTCCCCTC<br>CTTCATCAACAAGGACACCGAGACCATCAAC<br>ATGATGTCCGAGTTCGTCGCCAACCTCCCCCA<br>GGAGCTCAAGCTCACCCTCTCCGAGATGCAGC<br>CCGCCCTCCCCCAGCTCCAGCAGCACGTCCCC<br>GTCCTCAAGGACTCCTCCCTCCTCTTCGAGGA<br>GTTCAAGAAGCTCATCCGCAACCGCCAGTCCG<br>AGGCCGCCGACTCCTCCCCCTCCGAGCTCAAG<br>TACCTCGGCCTCGACACCCACTCCCGCAAGAA<br>GCGCCAGCTCTACTCCGCCCTCGCCAACAAGT<br>GCTGCCACGTCGGCTGCACCAAGCGCTCCCTC<br>GCCCGCTTCTGCGGCGGCGGCGGCTCCGGCGG<br>CGGCGGCTCCGGCGGCGGCGGCTCCGACATCC<br>AGATGACCCAGTCCCCCTCCTCCCTCTCCGCC<br>TCCGTCGGCGACCGCGTCACCATCACCTGCCG<br>CGCCTCCCGCCCCATCGGCACCATGCTCTCCT<br>GGTACCAGCAGAAGCCCGGCAAGGCCCCCAA<br>GCTCCTCATCCTCGCCTTCTCCCGCCTCCAGTC<br>CGGCGTCCCCTCCCGCTTCTCCGGCTCCGGCT<br>CCGGCACCGACTTCACCCTCACCATCTCCTCC<br>CTCCAGCCCGAGGACTTCGCCACCTACTACTG<br>CGCCCAGGCCGGCACCCACCCCACCACCTTCG<br>GCCAGGGCACCAAGGTCGAGATCAAGCGC | 5' UTR 1 | 3' UTR 1 | 316 |
| Construct 155 | ATGCCTCGCCTGTTTTTTTTCCACCTGCTAGGA<br>GTCTGTTTACTACTGAACCAATTTTCCAGAGC<br>AGTCGCGGACTCATGGATGGAGGAAGTTATTA<br>AATTATGCGGCCGCGAATTAGTTCGCGCGCAG<br>ATTGCCATTTGCGGCATGAGCACCTGGAGCAA<br>AAGGTCTCTGAGCCAGGAAGATGCTCCTCAGA<br>CACCTAGACCAGTGGCAGAAATTGTGCCATCC<br>TTCATCAACAAAGATACAGAAACCATAAATAT<br>GATGTCAGAATTTGTTGCTAATTTGCCACAGG<br>AGCTGAAGTTAACCCTGTCTGAGATGCAGCCA<br>GCATTACCACAGCTACAACAACATGTACCTGT<br>ATTAAAAGATTCCAGTCTTCTCTTTGAAGAAT<br>TTAAGAAACTTATTCGCAATAGACAAAGTGAA<br>GCCGCAGACAGCAGTCCTTCAGAATTAAAATA<br>CTTAGGCTTGGATACTCATTCTCGAAAAAAGA<br>GACAACTCTACAGTGCATTGGCTAATAAATGT<br>TGCCATGTTGGTTGTACCAAAAGATCTCTTGC<br>TAGATTTTGCGGTGGCGGAGGCAGCGGAGGT<br>GGTGGCAGCGGCGGAGGTGGCAGCGACATCC<br>AGATGACCCAGAGCCCCAGCAGCCTGAGCGC<br>CAGCGTGGGCGACAGGGTGACCATCACCTGC<br>AGGGCCAGCAGGCCCATCGGCACCATGCTGA<br>GCTGGTACCAGCAGAAGCCCGGCAAGGCCCC<br>CAAGCTGCTGATCCTGGCCTTCAGCAGGCTGC<br>AGAGCGGCGTGCCCAGCAGGTTCAGCGGCAG<br>CGGCAGCGGCACCGACTTCACCCTGACCATCA<br>GCAGCCTGCAGCCCGAGGACTTCGCCACCTAC<br>TACTGCGCCCAGGCCGGCACCCACCCCACCAC | 5' UTR 1 | 3' UTR 2 | 317 |

TABLE 6-continued

DNA Sequences

| Name | ORF Sequence | 5' UTR | 3' UTR | SEQ ID NO: |
|---|---|---|---|---|
| | CTTCGGCCAGGGCACCAAGGTGGAGATCAAG AGG | | | |
| Construct 156 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGAAATTGTGCCATCC TTCATCAACAAAGATACAGAAACCATAAATAT GATGTCAGAATTTGTTGCTAATTTGCCACAGG AGCTGAAGTTAACCCTGTCTGAGATGCAGCCA GCATTACCACAGCTACAACAACATGTACCTGT ATTAAAAGATTCCAGTCTTCTCTTTGAAGAAT TTAAGAAACTTATTCGCAATAGACAAAGTGAA GCCGCAGACAGCAGTCCTTCAGAATTAAAATA CTTAGGCTTGGATACTCATTCTCGAAAAAGA GACAACTCTACAGTGCATTGGCTAATAAATGT TGCCATGTTGGTTGTACCAAAAGATCTCTTGC TAGATTTTGCGGTGGCGGAGGCAGCGGAGGT GGTGGCAGCGGCGGAGGTGGCAGCGACATCC AGATGACCCAGAGCCCCAGCAGCCTGAGCGC CAGCGTGGGCGACAGGGTGACCATCACCTGC AGGGCCAGCAGGCCCATCGGCACCATGCTGA GCTGGTACCAGCAGAAGCCCGGCAAGGCCCC CAAGCTGCTGATCCTGGCCTTCAGCAGGCTGC AGAGCGGCGTGCCCAGCAGGTTCAGCGGCAG CGGCAGCGGCACCGACTTCACCCTGACCATCA GCAGCCTGCAGCCCGAGGACTTCGCCACCTAC TACTGCGCCCAGGCCGGCACCCACCCCACCAC CTTCGGCCAGGGCACCAAGGTGGAGATCAAG AGG | 5' UTR 1 | 3' UTR 1 | 318 |
| Construct 157 | ATGCCCCGCCTGTTCTTCTTCCACCTCCTTGGC GTGTGCCTCCTCCTCAACCAGTTCAGCCGGGC CGTGGCCGACAGCTGGATGGAGGAGGTCATC AAGCTCTGCGGCCGCGAGCTCGTCCGCGCCCA GATCGCCATCTGCGGCATGTCCACCTGGTCCA AGCGCTCCCTCTCCCAGGAGGACGCCCCACAG ACCCCGCGCCCCGTCGCCGAGATCGTCCCCTC CTTCATCAACAAGGACACCGAGACGATCAAC ATGATGTCCGAGTTCGTCGCCAACCTGCCGCA GGAGCTCAAGCTCACCCTCTCCGAGATGCAGC CCGCCCTCCCGCAGCTCCAGCAGCACGTCCCC GTCCTCAAGGACTCCTCCCTCCTCTTCGAGGA GTTCAAGAAGCTCATCCGCAACCGCCAGTCCG AGGCCGCCGACTCCAGCCCCTCCGAGCTGAAG TACCTCGGCCTCGACACCCACTCCCGCAAGAA GCGCCAGCTCTACTCCGCCCTCGCCAACAAGT GCTGCCACGTCGGCTGCACCAAGCGGTCCCTG GCCCGCTTCTGCGGAGGCGGCGGCTCTGGCGG TGGTGGATCCGGCGGCGGTGGCAGCGACATC CAGATGACCCAGTCCCCCATCCAGCCTGAGCGC CTCCGTCGGCGACCGCGTCACCATCACCTGCC GCGCCTCCCGCCCCATCGGCACCATGCTCTCC TGGTACCAGCAGAAGCCCGGCAAGGCCCCGA AGCTCCTCATCCTCGCCTTCTCCCGCCTCCAGT CCGGCGTCCCGTCAAGGTTCTCCGGCTCGGGC TCCGGTACCGACTTCACCCTCACCATCTCCTC GCTCCAGCCAGAGGACTTCGCCACCTACTACT GCGCCCAGGCCGGCACCCACCCCACCACCTTC GGCCAGGGCACCAAGGTCGAGATCAAGCGC | 5' UTR 1 | 3' UTR 3 | 319 |
| 5' UTR 1 | TCAAGCTTTTGGACCCTCGTACAGAAGCTAAT ACGACTCACTATAGGGAAATAAGAGAGAAAA GAAGAGTAAGAAGAAATATAAGAGCCACC | | | 320 |
| 3' UTR 1 | TGATAATAGTCCATAAAGTAGGAAACACTAC AGCTGGAGCCTCGGTGGCCATGCTTCTTGCCC CTTGGGCCTCCCCCCAGCCCCTCCTCCCCTTCC TGCACCCGTACCCCCCGCATTATTACTCACGG TACGAGTGGTCTTTGAATAAAGTCTGAGTGGG CGGC | | | 321 |

TABLE 6-continued

DNA Sequences

| Name | ORF Sequence | 5' UTR | 3' UTR | SEQ ID NO: |
|---|---|---|---|---|
| 3' UTR 2 | TGATAATAGGCTGGAGCCTCGGTGGCCATGCT TCTTGCCCCTTGGGCCTCCCCCCAGCCCCTCCT CCCCTTCCTGCACCCGTACCCCCGTGGTCTTTG AATAAAGTCTGAGTGGGCGGC | | | 322 |
| 3'UTR 3 | TGATAATAGGCTGGAGCCTCGGTGGCCATGCT TCTTGCCCCTTGGGCCTCCCCCCAGCCCCTCCT CCCCTTCCTGCACCCGTACCCCCGCATTATTA CTCACGGTACGAGTGGTCTTTGAATAAAGTCT GAGTGGGCGGC | | | 323 |
| 3'UTR 4 | TGATAATAGGCTGGAGCCTCGGTGGCCATGCT TCTTGCCCCTTGGGCCTCCCCCCAGCCCCTCCT CCCCTTCCTGCACCCGTACCCCCTCCATAAAG TAGGAAACACTACAGTGGTCTTTGAATAAAGT CTGAGTGGGCGGC | | | 324 |
| Relax in 2, transcript variant 1 [Homo sapiens] (NM_134441.2) | GTCCCGACCTCCAGGAGAGACCAGGCCCAGG ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGAAATTGTGCCATCC TTCATCAACAAAGATACAGAAACCATAAAATAT GATGTCAGAATTTGTTGCTAATTTGCCACAGG AGCTGAAGTTAACCCTGTCTGAGATGCAGCCA GCATTACCACAGCTACAACAACATGTACCTGT ATTAAAAGATTCCAGTCTTCTCTTTGAAGAAT TTAAGAAACTTATTCGCAATAGACAAAGTGAA GCCGCAGACAGCAGTCCTTCAGAATTAAAATA CTTAGGCTTGGATACTCATTCTCGAAAAAAGA GACAACTCTACAGTGCATTGGCTAATAAATGT TGCCATGTTGGTTGTACCAAAAGATCTCTTGC TAGATTTTGCTGAGATGAAGCTAATTGTGCAC ATCTCGTATAATATTCACACATATTCTTAATG ACATTTCACTGATGCTTCTATCAGGTCCCATC AATTCTTAGAATATCTAAGAATCTTTGTTAGA TATTAGGTCCCATCAATTCTTAGAATATCTAA ACATCTTTGTTGATGTTTAGATTTTTTATTTG ATGTGTAAGAAAATGTTCTTTGTGTGATTAAA TGACACATTTTTTTGCTGAAAAAAAAAA | | | 325 |
| RLN2, Prorelaxin H2. isoform 1 | <u>ATGCCTCGCCTGTTTTTTTTCCACCTGCTAGGA GTCTGTTTACTACTGAACCAATTTTCCAGAGC AGTCGCGGACTCATGGATGGAGGAAGTTATTA</u> AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGAAATTGTGCCATCC TTCATCAACAAAGATACAGAAACCATAAAATAT GATGTCAGAATTTGTTGCTAATTTGCCACAGG AGCTGAAGTTAACCCTGTCTGAGATGCAGCCA GCATTACCACAGCTACAACAACATGTACCTGT ATTAAAAGATTCCAGTCTTCTCTTTGAAGAAT TTAAGAAACTTATTCGCAATAGACAAAGTGAA GCCGCAGACAGCAGTCCTTCAGAATTAAAATA CTTAGGCTTGGATACTCATTCTCGAAAAAAGA GACAACTCTACAGTGCATTGGCTAATAAATGT TGCCATGTTGGTTGTACCAAAAGATCTCTTGC TAGATTTTGC | | | 2 |
| Relaxin 2, transcript variant 2 [Homo sapiens] (NM_005059.3) | GTCCCGACCTCCAGGAGAGACCAGGCCCAGG ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGGTGATTTTATTCAA ACAGTCTCACTGGGAATCTCACCGGACGGAG GGAAAGCACTGAGAACAGGAAGCTGCTTCAC | | | 326 |

TABLE 6-continued

DNA Sequences

| Name | ORF Sequence | 5' UTR | 3' UTR | SEQ ID NO: |
|---|---|---|---|---|
| | CCGAGAGTTCCTTGGTGCCCTTTCCAAATTGT GCCATCCTTCATCAACAAAGATACAGAAACCA TAAATATGATGTCAGAATTTGTTGCTAATTTG CCACAGGAGCTGAAGTTAACCCTGTCTGAGAT GCAGCCAGCATTACCACAGCTACAACAACAT GTACCTGTATTAAAAGATTCCAGTCTTCTCTTT GAAGAATTTAAGAAACTTATTCGCAATAGACA AAGTGAAGCCGCAGACAGCAGTCCTTCAGAA TTAAAATACTTAGGCTTGGATACTCATTCTCG AAAAAAGAGACAACTCTACAGTGCATTGGCT AATAAATGTTGCCATGTTGGTTGTACCAAAAG ATCTCTTGCTAGATTTTGCTGAGATGAAGCTA ATTGTGCACATCTCGTATAATATTCACACATA TTCTTAATGACATTTCACTGATGCTTCTATCAG GTCCCATCAATTCTTAGAATATCTAAGAATCT TTGTTAGATATTAGGTCCCATCAATTCTTAGA ATATCTAAACATCTTTGTTGATGTTTAGATTTT TTTATTTGATGTGTAAGAAAATGTTCTTTGTGT GATTAAATGACACATTTTTTGCTGAAAAAAA AAA | | | |
| RLN2, Prorelaxin H2. isoform 2 | ATGCCTCGCCTGTTTTTTTTCCACCTGCTAGGA GTCTGTTTACTACTGAACCAATTTTCCAGAGC AGTCGCGGACTCATGGATGGAGGAAGTTATTA AATTATGCGGCCGCGAATTAGTTCGCGCGCAG ATTGCCATTTGCGGCATGAGCACCTGGAGCAA AAGGTCTCTGAGCCAGGAAGATGCTCCTCAGA CACCTAGACCAGTGGCAGGTGATTTTATTCAA ACAGTCTCACTGGGAATCTCACCGGACGGAG GGAAAGCACTGAGAACAGGAAGCTGCTTCAC CCGAGAGTTCCTTGGTGCCCTTTCCAAATTGT GCCATCCTTCATCAACAAAGATACAGAAACCA | | | 4 |

TABLE 7

RNA Sequences

| Name | Sequence | 5' UTR | 3' UTR | SEQ ID NO: |
|---|---|---|---|---|
| Construct 1 | AUGCCCCGCCUGUUCUUCUUCCACCUCCUUGG CGUGUGCCUCCUCCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGUCCACCUGGUCCA AGCGCUCCCUCUCCCAGGAGGACGCCCCCACAG ACCCCGCGCCCCGUCGCCGAGAUCGUCCCCUC CUUCAUCAACAAGGACACCGAGACGAUCAACA UGAUGUCCGAGUUCGUCGCCAACCUGCCGCAG GAGCUCAAGCUCACCCUCUCCGAGAUGCAGCC CGCCCUCCCGCAGCUCCAGCAGCACGUCCCCG UCCUCAAGGACUCCUCCCUCCUCUUCGAGGAG UUCAAGAAGCUCAUCCGCAACCGCCAGUCCGA GGCCGCCGACUCCAGCCCCAGCGAACUGAAGU ACCUCGGCCUCGACACCCACUCCCGCAAGAAG CGCCAGCUCUACUCCGCCCUCGCCAACAAGUG CUGCCACGUCGGCUGCACCAAGCGGUCCCUGG CCCGCUUCUGCGGAGGCGGCGGCUCUGGCGGU GGUGGAUCCGGCGGCGGUGGCGGCGACAUCCA GAUGACCCAGUCCCCAUCCAGCCUGAGCGCCU CCGUCGGCGACCGCGUCACCAUCACCUGCCGC GCCUCCCGCCCCAUCGGCACCAUGCUCUCCUG GUACCAGCAGAAGCCCGGCAAGGCCCCGAAGC UCCUCAUCCUCGCCUUCUCCCGCUCCAGUCC GGCGUCCCGUCAAGGUUCUCCGGCUCGGGCUC CGGUACCGACUUCACCCUCACCAUCUCCUCGC UCCAGCCAGAGGACUUCGCCACCUACUACUGC GCCCAGGCCGGCACCCACCCCACCACCUUCGG CCAGGGCACCAAGGUCGAGAUCAAGCGC | 5' UTR 1 | 3' UTR 1 | 5 |
| Construct 2 | AUGCCCAGACUGUUCUUCUUCCACCUCCUCUG CGUGUGCCUCCUCCUUAACCAGUUCAGCCGGG CCGUGGCCGACAGCUGGAUGGAGGAGGUGAUC AAGCUAUGCGGCCGGGAGCUCGUGCGGGCCCA GAUCGCCAUCUGCGGCAUGAGCACCUGGAGCA AGCGGAGCCUGAGCCAGGAGGACGCCCCCUCAG ACCCCGCGGCCAGUGCCGAGAUCGUGCCCAG CUUCAUCAACAAGGACACCGAGACAAUCAACA UGAUGAGCGAGUUCGUGGCCAACCUGCCCCAG GAGCUGAAGCUGACCCUGAGCGAGAUGCAGCC CGCCCUGCCGCAGCUGCAGCAGCACGUGCCCG UGCUGAAGGACAGCAGCCUGCUGUUCGAGGAG UUCAAGAAGCUGAUCCGGAACCGGCAGAGCGA GGCCGCCGACUCCAGCCCCAGCGAACUGAAGU ACCUGGGCCUGGACACCCACAGCCGGAAGAAG CGGCAGCUGUACAGCGCCCUGGCCAACAAGUG CUGCCACGUGGGCUGCACCAAGCGAUCCCUGG CCCGGUUCUGCGGCGGCGGAGGCAGCGGCGGU GGCGGAAGCGGAGGCGGCAGCGACAUCCA GAUGACCCAGAGCCCAAGCUCCCUGUCCGCCA GCGUGGGCGACCGGGUGACCAUCACCUGCCGG GCCAGCCGGCCCAUCGGCACCAUGCUGAGCUG GUACCAGCAGAAGCCCGGCAAGGCCCCGAAGC UGCUGAUCCUGGCCUUCUCCCGCUCCGAGAGC GGCGUGCCGAGCCGGUUCAGCGGCUCCGGCAG CGGAACCGACUUCACCCUGACCAUCUCAAGCC UGCAGCCGGAGGACUUCGCCACCUACUACUGC GCCCAGGCCGGCACCCACCCCACCACCUUCGG CCAGGGCACCAAGGUGGAGAUCAAGCGG | 5' UTR 1 | 3' UTR 1 | 327 |

TABLE 7-continued

RNA Sequences

| Name | Sequence | 5' UTR | 3' UTR | SEQ ID NO: |
|---|---|---|---|---|
| Construct 3 | AUGCCUCGCCUGUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCG AGAUUGCCAUUUGCGGCAUGAGCACCUGGAGC AAAAGGUCUCUGAGCCAGGAAGAUGCUCCUCA GACACCUAGACCAGUGGCAGAAAUUGUGCCAU CCUUCAUCAACAAAGAUACAGAAACCAUAAAU AUGAUGUCAGAAUUGUUGCUAAUUUGCCAC AGGAGCUGAAGUUAACCCUGUCUGAGAUGCA GCCAGCAUUACCACAGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAAUACUUAGGCUUGGAUACUCAUUCUCGA AAAAAGAGACAACUCUACAGUGCAUUGGCUA AUAAAUGUUGCCAUGUUGGUUGUACCAAAAG AUCUCUUGCUAGAUUUUGC | 5' UTR 1 | 3' UTR 4 | 328 |
| Construct 4 | AUGCCUAGGCUCUUUUUCUUCCACUUGCUAGG GGUGUGCUUGUUGUUAAACCAGUUUAGUAGA GCGGUCGCCGAUUCUUGGAUGGAGGAAGUGA UAAAGCUCUGUGGGCGGGAAUUAGUCCGCGCA CAAAUUGCCAUAUGCGGAAUGGGUGGGGCC GUAGUGGCGGAGGAGGUUCCGGGGGAGGAGG GAGCGGCGGAGGAGGCUCAGGCGGCGGAGGA AGUGGUGGCGGUGGCUACAGGGAGGAGGGAU CUGGGGGCGGCGGAAGCGGCGGAGGAGGAUC UGGGGGCGGUGGAAGUGGCGGAGGUGGGUCU GGCGGGGGAGGGAGUGGCGGGGGCGGUUCCG GGGGUGGAGGCAGCGGAGGCGGUGGCUCCGG GGGGGUGGUUCCGGUGGUGGCGGGUCAGGA GGAGGGGGGUCAGGCGGCGGAGGAUCCGGCG GCGGCGGCUCCCAACUUUAUUCGGCUCUGGCU AAUAAAUGCUGUCACGUGGGCUGCACCAAACG UUCGCUUGCGCGGUUUUGU | 5' UTR 1 | 3' UTR 2 | 329 |
| Construct 5 | AUGCCUCGACUGUUUUUCUUUCACCUCCUAGG AGUCUGCUUACUUCUCAACCAGUUCAGUAGGG CAGUCGCGGACUCAUGGAUGGAAGAGGUUAU UAAAUUAUGUGGCCGUGAAUUGGUGCGUGCA CAAAUAGCUAUUUGCGGCAUGGGCGGUGGCG GCUCUGGUGGCGGCGGCUCUGGAGGGGGCGGA AGUGGUGGAGGAGGUAGUGGCGGAGGGGAU CGGGAGGCGGAGGAUCUGGAGGGGGGGGCUC CUUUCAAAGCUCCUCGAGCAAAGCGCCCCCUC CCAGCCUGCCCAGCCCUAGUAGGCUGCCCGGU CCGAGCGACACGCCCAUCCUGCCCCAGGGUGG CGGUGGCUCUGGGGGUGGCGGUUCAGGCGGA GGUGGUUCUGGCGGAGGCGGAUCAGGUGGUG GGGGAUCCGGCGGCGGCGGAUCUGGUGGCGGG GGGGAGCUCUCACUGGCCGCUGGGCCCAAUAA AUGGCUAGAUUUUGC | 5' UTR 1 | 3' UTR 2 | 330 |
| Construct 6 | AUGCCUCGCCUGUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCG AGAUUGCCAUUUGCGGCAUGGAGCCCAAGAGC AGCGACAAGACCACCAGCCCCCCCAGCCC CGCCCCCGAGCUGCUGGGCGGCAGCAGCGUGU UCCUGUUCCCCCCAAGCCCAAGGACACCCUG UACAUCACCAGGGAGCCCGAGGUGACCUGCGU GGUGGUGGACGUGAGCCACGAGGACCCCGAGG UGAAGUUCAACUGGUACGUGGACGGCGUGGA GGUGCACAACGCCAAGACCAAGCCCAGGGAGG AGCAGUACAACAGCACCUACAGGGUGGUGAGC GUGCUGACCGUGCUGCACCAGGACUGGCUGAA CGGCAAGGAGUACAAGUGCAAGGUGAGCAAC AAGGCCCUGCCCGCCCCCAUCGAGAAGACCAU CAGCAAGGCCAAGGGCCAGCCCCGGGAGCCCC AGGUGUACACCCUGCCCCCCAGCAGGGACGAG CUGACCAAGAACCAGGUGAGCCUGACCUGCCU GGUGAAGGGCUUCUACCCCAGCGACAUCGCCG UGGAGUGGGAGAGCAACGGCCAGCCCGAGAAC AACUACAAGACCACCCCCCCGUGCUGGACAG CGACGGCAGCUUCUUCCUGUACAGCAAGCUGA CCGUGGACAAGAGCAGGUGGCAGCAGGGCAAC GUGUUCAGCUGCAGCGUGAUGCACGAGGCCCU GCACAACCACUACACCCAGAAGAGCCUGAGCC UGAGCCCCGGCAAGAGGAAGAGCACCUGGAGC AAAAGGUCUCUGAGCCAGGAAGAUGCUCCUCA GACACCUAGACCAGUGGCAGAAAUUGUGCCAU CCUUCAUCAACAAAGAUACAGAAACCAUAAAU AUGAUGUCAGAAUUGUUGCUAAUUUGCCAC AGGAGCUGAAGUUAACCCUGUCUGAGAUGCA GCCAGCAUUACCACAGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAAUACUUAGGCUUGGAUACUCAUUCUCGA AAAAAGAGACAACUCUACAGUGCAUUGGCUA AUAAAUGUUGCCAUGUUGGUUGUACCAAAAG AUCUCUUGCUAGAUUUUGC | 5' UTR 1 | 3' UTR 2 | 331 |
| Construct 7 | AUGCCCAGGCUGUUCUUCUUCCACCUGCUGGG AGUGUGCCUCCUGCUGAACCAGUUCAGCCGCG CCGUGGCCGACAGCUGGAUGGAGGAGGUGAUC AAGCUGUGCGGGAGGGAGCUGGUCCGAGCCCA AAUGCCAUCUGCGGCAUGAGCACCUGGAGCA AGAGAAGCCUGUCCCAGGAGGAUGCCCCCCAA ACGCCCAGGCCCGUGGCCGAGAUCGUGCCCAG CUUCAUCAACAAGGACACCGAGACCAUCAACA UGAUGUCCGAGUUGUGGCCAACCUGCCCAG GAGCUGAAGCUGACCCUGCUGAGAUGCAGCC AGCCCUCCCCCAGCUGCAGCAGCACGUGCCCG UGUUGAAGGACAGCAGCCUGCUGUUCGAGGA GUUCAAAAAGCUGAUACGCAACAGGCAGAGCG AGGCGGCCGACAGCUCCCCGUCGGAGCUGAAG UACCUGGGGCUGGACACCCUCACAGCCGGAAGAA GCGGCAGCUGUACAGCGCACUGGCCAACAAAU GUUGCCACGUGGGCUGCACCAAGAGGAGCCUG GCCAGGUUCUGC | 5' UTR 1 | 3' UTR 4 | 332 |
| Construct 8 | AUGCCCAGGCUGUUCUUCUUCCACCUCCUGGG UGUGUGCCUGCUGCUGAACCAGUUUAGCAGGG CCGUGGCCGACAGCUGGAUGGAGGAGGUGAUC AAGCUGUGCGGCAGGGAGCUGUGCGAGCGCA GAUCGCCAUCUGCGGCAUGAGCACCUGGAGUA AGAGGAGCCUCUCCCAGGAGGACGCCCCCCAG ACGCCCAGGCCCGGUGGCGAGAUCGUGCCCUC CUUCAUCAACAAGGACACAGAGACCAUCAACA UGAUGAGCGAGUUGUGGCCAACCUGCCCCAG GAACUUAAGCUGACCCUCAGCGAGAUGCAGCC GGCCCUUCCCCAGCUGCAGCAGCACGUGCCCG UGCUGAAGGACAGCAGCCUGCUGUUCGAGGA UUCAAAAAGCUGAUCCGCAAUAGGCAGAGCGA GGCCGCCGACUCCAGCCCCAGCGAGCUGAAGU AUCUGGGGCUGGACACCCUCACAGCAGGAAGAA CGGCAGCUGUACAGCGCGCUGGCCAACAAGUG CUGCCACGUGGGCUGCACCAAGAGGUCGCUCG CCAGGUUCUGC | 5' UTR 1 | 3' UTR 4 | 333 |
| Construct 9 | AUGCCCAGGCUGUUCUUCUUUCACCUGCUGGG CGUGUGUCUGCUGCUCAACCAGUUUAGCCGCG CCGUGGCCGACAGCUGGAUGGAGGAGGUCAUA AAGCUGUGCGGGAGGGAACUGGUGAGGGCCC AGUCGCCAUCUGCGGAAUGUCCACCUGGAGC AAGAGGAGCCUGAGCCAGGAGGACGCCCCACA GACUCCGGGCCGGUUGCGGAGAUCGUGCCCU CCUUCAUCAAUAAAGAUACCGAGACCAUCAAC AUGAUGCGAGUAUGGCCCAACUGCCCCGCA GGAGCUGAAACUCACCCUCAGCGAGAUGCAGC CCGCGCUGCCCCAGCUGCAGCAGCACGUGCCC GUGCUGAAGGACAGCAGCCUGCUGUUUGAAG AAUUCAAAAAACUGAUCCGGAACCGACAGAGC GAGGCCGCCGACUCCAGCCCCAGCGAACUGAA | 5' UTR 1 | 3' UTR 4 | 334 |

TABLE 7-continued

RNA Sequences

| Name | Sequence | 5' UTR | 3' UTR | SEQ ID NO: |
|------|----------|--------|--------|------------|
| | GUACCUGGGGCUGGACACCCACAGCCGGAAAA AGCGGCAGCUGUACAGCGCACUGGCCAAUAAG UGUUGCCACGUCGGCCUGCACGAAGCGGUCCCU UGCCCGCUUCUGC | | | |
| Construct 10 | AUGCCCCGCCUGUUCUUCUUUCACCUGCUGGG CGUGUGCCUGCUGCUGAACCAGUUCAGCAGGG CCGUGGCCGACAGCUGGAUGGAAGAGGUGAUC AAGCUCUGCGGCAGGGAACUGGUGAGGGCCCA GAUCGCCAUCUGCGGCAUGUCCACCUGGUCCA AAAGGAGCCUCAGCCAGGAGGACGCCCCCCAG ACCCCCGGCCAGUGGCCGAGAUCGUGCCCUC CUUCAUCAACAAGGACACCGAGACUAUCAACA UGAUGUCCGAGUUCGUGGCCAACCUGCCCCAG GAGCUGAAGCUGACCCUGAGCGAGAUGCAGCC CGCGCUGCCCCAGCUGAACAGCACGUGCCCG UGCUGAAGGACAGCAGCCUGCUGUUUGAGGA GUUCAAGAAGCUGAUCCGCAACAGGCAGAGCG AGGCCGCCGACUCCAGCCCCAGCGAACUGAAA UAUCUGGGGCUGGACACCCACUCCCGGAAGAA GAGGCAGCUGUACAGCGCCCUGGCCAACAAAU GCUGCCACGUGGGGUGCACGAAGCGGUCCCUG GCCCGCUUUUGC | 5' UTR 1 | 3' UTR 4 | 5 |
| Construct 11 | AUGCCCAGGCUGUUUUUCUUCCACCUCCUGGG CGUGUGCCUGCUGCUGAAUCAGUUUUUCCCGGG CCGUGGCCGACAGCUGGAUGGAGGAGGUGAUC AAGCUGUGUGGCCGGGAGCUGGUUCGGGCCCA GAUAGCCAUCUGUGGAAUGAGCACCUGGAGCA AGCGGAGCCUGUCCCAGGAGGACGCCCCCCAG ACACCCGGCCGGUGGCCGAAAUCGUCCCCAG CUUCAUCAACAAGGACACCGAGACCAUCAACA UGAUGAGCGAGUUCGUGGCCAACCUGCCCCAG GAGCUGAAGCUGACGCUGAGCGAGAUGCAGCC UGCCCUGCCCCAGCUGAACAGCACGUGCCUG UGCUGAAGGACAGCAGCCUCCUGUUCGAGGAG UUCAAGAAGCUCAUCAGGAACCGGCAGAGCGA GGCCGCUGACAGCUCACCCAGCGAGCUGAAGU ACCUGGGCCUGGACACCCACUCGAGGAAGAAG CGGCAGCUGUACAGCGCCCUGGCCAACAAGUG UUGCCAUGUGGGCUGUACCAAGAGGAGCCUGG CCAGGUUCUGC | 5' UTR 1 | 3' UTR 4 | 336 |
| Construct 12 | AUGCCCCGACUGUUCUUUUUCCACCUGCUGGG GGUGUGCCUGCUGCUGAACCAGUUUUUCGAGGG CGGUGGCGGACAGUUGGAUGGAGGAGGUCAU CAAGCUCUGCGGGAGGGAGCUCGUCAGGGCCC AGAUCGCCAUCUGCGGAAUGAGCACCUGGAGC AAGCGUUCGCUGUCCCAGGAGGACGCCCCCCA GACCCCCGAGACCCGUGGCCGAGAUCGUGCCCA GCUUCAUCAACAAGGAUACCGAAACCAUCAAC AUGAUGAGCGAGUUCGUGGCCAACCUCCCGCA GGAGCUCAAGCUCACGCUGAGCGAGAUGCAGC CGGCCCUGCCCCAGCUGCAGCAGCAUGUCCCC GUCCUGAAGGACAGCAGCCUGCUGUUCGAGGA GUUCAAGAAAACUGAUCCGGAACCGGCAGAGCG AGGCCGCCGAUAGCAGCCCCAGCGAGCUGAAG UACCUGGGGCUGGACACCCACAGUCGCAAGAA GCGGCAGCUGUACAGCGCCCUGGCCAACAAGU GUUGCCACGUCGGGUGUACGAAGCGCUCCCUG GCCAGAUUCUGC | 5' UTR 1 | 3' UTR 4 | 337 |
| Construct 13 | AUGCCCCGGCUGUUCUUUUUCCACCUGCUGGG CCGUCGCAGAAUUCCUGAUGGAGGAGGUGAUC AAGCUGUGCGGCCGGGAGCUCGUGAGGGCCCA GAUCGCCAUUUGCGGCAUGUCCACCUGGAGCA AGCGGAGCCUGAGCCAGGAGGACGCGCCGCAG ACUCCCGGCCGGUGGCCGAAAUCGUGCCCUC CUUCAUCAAUAAGGACACCGAAACCAUAAACA UGAUGAGCGAGUUUGUGGCCAACCUGCCACAG GAGCUGAAACUGACGCUGAGCGAGAUGCAGCC CGCGCUGCCCCAGCUGCAGCAGCAUGUGCCCG UGCUGAAGGACAGCAGCCUGCUGUUCGAGGAA | 5' UTR 1 | 3' UTR 4 | 338 |
| | UUUAAGAAGCUAAUCCGGAACAGGCAGAGCG AGGCCGCCGACAGCUCCCCCGAGCGAGCUGAAG UACCUCGGGCUGGACACCCACAGCCGGAAGAA GCGGCAACUGUACAGCGCCCUGGCGAACAAGU GCUGCCACGUGGGCUGUACCAAAAGAAGCCUC GCCCGCUUCUGC | | | |
| Construct 14 | AUGCCUAGGCUCUUCUUCUUCCACCUGCUGGG CGUCUGCCUGCUGCUGAACCAAUUCAGCCGGG CCGUAGCCGACUCCUGGAUGGAGGAGGUGAUC AAACUGUGCGGGAGGGACUGGUGAGGUGAUC AAAUCGCGAUCUGCGGCAUGUCCACCUGGAGC AAGCGGAGCCUGUCAGGAAGAUGCCCCCCA GACCCCCAGGCCGGUGGCCGAGAUCGUCCCCA GCUUCAUCAACAAGGAUACCGAAACCAUAAAC AUGAUGAGCGAGUUUGUGGCCAACCUCCCCCA GGAGCUGAAGCUGACCCUCAGCGAGAUGCAGC CCGCCCUGCCGCAGCUGAACAGCACGUGCCC GUGCUGAAGGACAGCAGCCUGCUGUUCAAGA GUUCAAGAAGCUGAUCCGGAACCGGCAGAGCG AGGCCGCCGACAGCUCCCCCUCCGAGCUGAAG UACCUGGGCCUGGACACGCACAGCCGGAAGAA GCGGCAGCUGUACAGCGCCACUGGCCAACAAGU GCUGUCACGUCGGCUGCACCAAGCGUAGCCUG GCCAGAUUCUGC | 5' UTR 1 | 3' UTR 4 | 339 |
| Construct 15 | AUGCCCAGGCUGUUCUUCUUCCACCUGCUGGG CGUGUGCCUGCUGCUCAACCAGUUCAGCAGGG CCGUGGCCGACAGCUGGAUGGAGGAGGUGAUC AAACUGUGCGGGAGGGAGCUGGUGAGGGCGC AGAUCGCCAUCUGCGGCAUGAGCACCUGGAGC AAGAGGAGCCUCAGCCAGGAGGACGCCCCCCAG GACCCCCAGGCCCGUGGCCGAGAUCGUCCCCA GCUUCAUCAACAAGGACACCGAAACCAUCAAC AUGAUGAGCGAGUUCGUGGCCAACCUGCCCCA GGAGCUGAAGCUGACGCUGAGCGAGAUGCAGC CCGCCCUGCCCCAGCUGCAGCAGCACGUGCCC GUGCUGAAGGACAGCAGCCUGCUGUUCGAGGA GUUCAAGAAGCUGAUCCGUAACAGGCAGAGCG AGGCCGCCGACUCCCCCGCGAGCGAGCUGAAG UACCUGGGCCUGGACACCCACUCCCGGAAGAA GAGGCAGCUGUACAGUGCGCUGGCCAACAAAU GUUGCCAUGUGGGCUGCACCAAGCGGAGCCUG GCCCGCUUCUGC | 5' UTR 1 | 3' UTR 4 | 340 |
| Construct 16 | AUGCCCAGGCUGUUCUUUUUCCACCUGCUGGG GGUCUGCCUCCUGCUGAACCAGUUCUCCAGGG CGGUCGCCGACAGCUGGAUGGAAGAGGUCAUC AAGCUGUGCGGGAGGGAGCUGGUCAGGGCCA GAUCGCCAUCUGUGGCAUGUCCACCUGGAGCA AGAGGAGCCUGAGCCAGGAGGACGCGCCGCAG ACGCCCCGUCCGUGGCCGAGAUAGUGCCGAG CUUCAUCAACAAGGACACCGAGACUAUCAACA UGAUGAGCGAGUUCGUGGCCAACCUCCCUCAG GAGCUGAAGCUGACCCUGAGCGAGAUGCAGCC CGCCUCCCCCAGCUGCAACAGCACGUGCCCG UGCUGAAGGACAGCAGCCUCCUGUUCGAGGAG UUCAAGAAGCUGAUCCGGAAUAGGCAGAGCG AGGCCGCCGAUAGCUCGCCCAGCGAGCUUAAG UACCUGGGCCUCGACACACACAGCAGGAAGAA GAGGCAGCUGUACAGCGCCCUGGCCAACAAGU GUUGCCACGUCGCUGCACUAAGCGGAGCCUC GCUAGGUUCUGC | 5' UTR 1 | 3' UTR 4 | 341 |
| Construct 17 | AUGCCCCGACUGUUCUUCUUCCAUCUGCUGGG CGUGUGCCUCCUGCUGAAUCAAUUCAGCAGGG CCGUGGCCGACUCCUGGAUGGAGGAGGUCAUC AAGCUGUGCGGCAGGGAACUGGUGAGGGCGC AGAUCGCCAUCUGCGACAUGUCCACUGGAGC AAGAGGUCCUGUCCAGGAGGACGCCCCCCA GACCCCGAGGCCCGUGGCCGAGAUCGUGCCCA GCUUCAUCAACAAGGACACCGAGACCAUCAAU AUGAUGUCCGAGUUCGUGGCCAACCUCCCCUCA GGAGCUGAAGCUGACCCUGUCCGAGAUGCAGC | 5' UTR 1 | 3' UTR 4 | 342 |

TABLE 7-continued

RNA Sequences

| Name | Sequence | 5' UTR | 3' UTR | SEQ ID NO: |
|---|---|---|---|---|
| | CCGCCCUGCCGCAGCUUCAGCAGCACGUGCCC GUGCUGAAGGACAGCAGCCUGCUGUUCGAGGA AUUCAAGAAGCUGAUUAGGAACAGGCAAAGC GAGGCCGCCGACUCCAGCCCGAGCGAGCUGAA GUACCUGGGCCUCGACACCCAUAGCCGCAAGA AGCGGCAGCUGUACUCGGCCCUGGCGAACAAG UGCUGCCACGUGGGCUGCACCAAGCGCAGCCU GGCGCGCUUCUGC | | | |
| Construct 18 | AUGCCCAGGCUGUUUUUCUUCCACCUGCUGGG GGUCUGCUGCUGCUGAACCAGUUUAGCAGGG CCGUGGCCGACAGCUGGAUGGAGGAGGUGAUC AAGCUGUGCGGCAGGGAGCUGGUGCGGGCCCA GAUCGCCAUCUGCGGCAUGAGCACCUGGAGCA AGCGGUCCCUGAGCCAGGAGGACGCCCCCCAG ACUCCCCGGCCGGUGCCGAAAUCGUGCCCAG CUUCAUCAACAAGGACACCGAGACCAUCAUA UGAUGUCCGAGUUCGUGGCCAACCUGCCCCAG GAGCUGAAACUGACCCUGAGCGAGAUGCAGCC CGCCCUGCCCAGCUGCAGCAGCAUGUCCCCG UGCUGAAGGACAGCAGCCUGUUGUUGAGGA GUUCAAAAAACUGAUCCGAAACAGGCAGUCGG AGGCCGCUGACAGCGCCCUGCUGAGCGAGUAG UAUCUGGGGCUGGACACCCACAGCCGCAAGAA GAGGCAGCUGUAUAGCGCGCUGGCCAACAAGU GCUGCCACGUGGGCUGCACGAAGAGGUCCCUG GCCAGGUUCUGC | 5' UTR 1 | 3' UTR 4 | 343 |
| Construct 19 | AUGCCCAGGCUGUUCUUCUUCCACCUGCUGGG CGUGUGCCUGCUGCUGAACCAGUUCAGCAGGG CCGUGGCCGACAGCUGGAUGGAGGAGGUGAUC AAGCUGUGCGGCCGGGAGCUGGUGCGGGCCCA GAUCGCGAUCUGCGGCAUGAGCACCUGGAGCA AAAGGAGCUGAGCCAGGAGGACGCCGCCGCAG ACGCCCAGGCCCGUCGCCGAGAUCGUGCCGUC CUUCAUCAACAAGGACACCGAGACCAUCAUA UGAUGAGCGAGUUCGUGGCCAACCUGCCCCAG GAGCUCAAGCUGACCCUGAGCGAGAUGCAGCC CGCGCUGCCCAGCUGCAGCAGCACGUGCCCG UGCUGAAGGACUCCAGCCUGCUGUUCGAGGA UUCAAGAAACUGAUCAGAAACAGGCAGAGCG AGGCCGCCGACUCCAGCCCCUCAGAGCUGAAG UACCUGGGCCUGGACACCCACAGCAGGAAGAA GCGCCAGCUCUACAGCGCCCUGGCCAACAAGU GCUGCCACGUCGGGGCACAAAGAGGAGCCUG GCCAGGUUCUGC | 5' UTR 1 | 3' UTR 4 | 344 |
| Construct 20 | AUGCCCCGGCUGUUCUUCUUCCACCUGCUGGG CGUGUGCCUCCUGCUGAACCAGUUCAGCAGGG CCGUGGCCGACAGCUGGAUGGAGGAGGUGAUC AAGCUGUGCGGCAGGGAGCUGGUGAGGGCGC AGAUCGCCAUCUGCGGCAUGAGCACCUGGAGC AAGAGGAGCCUGAGCCAGGAGGACGCCCCCGA AACCCCCCGGCCGGUCGCGGAGAUAGUGCCCA GCUUCAUAAACAAGGACACCGAGACCAUCAAU AUGAUGAGCGAGUUCGUGGCCGAACCUGCCCCA GGAGCUCAAGCUGACCCUGAGCGAGAUGCAGC CGGCCCUGCCGCAGCUGCAGCAGCACGUGCCC GUGCUGAAGGACAGCAGCCUCCUGUUCGAGGA GUUCAAGAAGCUGAUCAGGAACCGGCAGAGCG AGGCCGCCGACUCCAGCCCGAGCGAGCUGAAG UACCUGGGCCUGGACACCCAUAGCAGGAAGAA GCGCCAGCUGUACAGCGCCCUGGCUAACAAGU GCUGCCACGUGGGCUGCACCAAGAGGAGCCUG GCCCGGUUCUGC | 5' UTR 1 | 3' UTR 4 | 345 |
| Construct 21 | AUGCCCCGGCUGUUCUUCUUCCACCUGCUCGG CGUGUGCCUGCUGCUGAACCAAUUCAGCGGG CCGUCGGCCGACAGCUGGAUGGAGGAGGUGAUC AAGCUGUGCGGCAGGGAGCUGGUCAGGGCCCA GAUCGCCAUCUGUGGGAUGUCGACCUGGUCCA AGCGCAGCCUGAGCCAGGAGGACGCCCCCCAG ACCCCAAGACCCGUGGCCGAGAUCGUGCCCAG CUUCAUCAACAAAGAUACCGAGACCAUCAACA | 5' UTR 1 | 3' UTR 4 | 346 |
| | UGAUGAGCGAGUUCGUGGCCAACCUCCCCCAG GAGCUGAAGCUGACCCUCAGCGAGAUGCAGCC CGCGCUGCCCCAGCUGCAGCAGCACGUGCCCG UGCUGAAGGACAGCUCCCUGCUGUUCGAGGAG UUCAAGAAGCUGAUCCGGAACAGGCAGUCCGA GGCCGCCGACAGCAGCCCCAGCGAGCUGAAGU ACCUGGGGCUGGACACUCACAGCAGGAAGAAG CGGCAGCUGUACAGCGCCCUGGCCAACAAGUG CUGCCACGUGGGCUGUACCAAACGCAGCCUCG CCAGGUUCUGC | | | |
| Construct 22 | AUGCCCAGGCUGUUCUUCUUCCACCUGCUGGG GGUCUGUCUCCUGCUGAACCAGUUCAGCCGGG CCGUGGCCGACUCCUGGAUGGAGGAGGUGAUC AAGCUGUGCGGGAGCUGGUGCGGGCCGCA GAUCGCCAUCUGCGGCAUGUCAACCUGGUCCA AAAGGUCCCUCAGCCAGGAAGACGCCCCCCAG ACCCCCAGGCCCGUGGCCGAAAUCGUGCCCAG CUUUAUCAACAAGGACACCGAGACCAUCAACA UGAUGAGCGAGUUUGUGGCCAACCUCCCCCAG GAGCUGAAGCUGACCCUGAGCGAGAUGCAGCC CGCGCUGCCCAACUGCAGCAGCACGUGCCGG UGCUGAAGGACAGCAGCCUGCUGUUCGAGGAG UUCAAGAAGCUCAUCAGGAACAGGCAGAGCGA GGCCGCCGAUUCGAGCCCCAGCGAGCUCAAGU ACCUGGGGCUGGACAUCACAGCCGGAAGAAG CGGCAGCUGUACAGCGCCCUGGCGAACAAGUG UUGCCACGUGGGCUGCACCAAGAGGAGCCUGG CCAGGUUCUGU | 5' UTR 1 | 3' UTR 4 | 347 |
| Construct 23 | AUGCCCAGGCUGUUCUUUUCCACCUCCUGGG GGUGUGUCUGCUCCUGAACCAGUUCAGCAGGG CCGUGGCCGAUUCCUGGAUGGAGGAGGUCAUC AAGCUGUGUGGAAGGGAGCUGGUGAGGGCCC AGAUCGCCAUCUGCGGGAUGUCCACCUGGAGC AAGCGGAGCCUGUCCCAGGAGGACGCCCCGCA GACCCCCAGGCCGGUGGCGGAGAUCGUCCCCA GCUUCAUCAACAAGGACACCGAGACCAUCAAC AUGAUGAGCGAGUUCGUGGCCAACCUGCCCCA GGAACUGAAGCUGACCCUCCUCGAGUGAGCAGAC CCGCCCUGCCCCAGCUGCAGCAGCAUGUGCCC GUGCUGAAGGACAGCAGCCUGCUCUUCGAGGA GUUCAAGAAGCUGAUCAGGAACAGGCAGAGC GAGGCCGCCGACUCCAGCCUCCCCGAGCUGAA GUACCUUGACUGGACACCCACAGCCGGAAGA AGCGGCAACUGUACUCCGCCCUGGCCAACAAG UGCUGCCACGUGGGCUGUACGAAGAGGAGCCU GGCCAGGUUCUGC | 5' UTR 1 | 3' UTR 4 | 348 |
| Construct 24 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUGAUC AAGCUGUGCGGCCGGGAGCUGGUGCGGGCCCA GAUCGCCAUCUGCGGCAUGAGCACCUGGAGCA AGCGGAGCCUGAGCCAGGAGGACGCCCCCCAG ACCCCCCGGCCCGUGGCCGAGAUCGUGCCCAG CUUCAUCAACAAGGACACCGAGACCAUCAACA UGAUGAGCGAGUUCGUGGCCAACCUGCCCCAG GAGCUGAAGCUGACCCUGAGCGAGAUGCAGCC CGCCCUGCCCAGCUGCAGCAGCACGUGCCCG UGCUGAAGGACAGCAGCCUGCUGUUCGAGGAG UUCAAGAAGCUGAUCCGGAACCGGCAGAGCGA GGCCGCCGACAGCAGCCCCAGCGAGCUGAAGU ACCUGGGCCUGGACACCCACAGCCGGAAGAAG CGGCAGCUGUACAGCGCCCUGGCCAACAAGUG CUGCCACGUGGGCUGCACCAAGCGGAGCCUGG CCCGGUUCUGC | 5' UTR 1 | 3' UTR 4 | 349 |
| Construct 25 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUGAUC AAGCUGUGCGGGAGGGAGCUGGUGAGGGCGC AGAUCGCGAUCUGCGGGAUGAGCACGUGGAGC AAGAGGAGCCUGAGCCAGGAGGACGCGCCGCA | 5' UTR 1 | 3' UTR 4 | 350 |

TABLE 7-continued

RNA Sequences

| Name | Sequence | 5' UTR | 3' UTR | SEQ ID NO: |
|------|----------|--------|--------|------------|
| | GACGCCGAGGCCGGUGGCGGAGAUCGUGCCGA<br>GCUUCAUCAACAAGGACACGGAGACGAUCAAC<br>AUGAUGAGCGAGUUCGUGCGAACCUGCCGCA<br>GGAGCUGAAGCUGACGCUGAGCGAGAUGCAGC<br>CGGCGCUGCCGCAGCUGCAGCAGCACGUGCCG<br>GUGCUGAAGGACAGCAGCAGCCUGCUGUUCGAGGA<br>GUUCAAGAAGCUGAUCAGGAACAGGCAGAGC<br>GAGGCGGCGGACAGCAGCCCGAGCGAGCUGAA<br>GUACCUGGGGCUGGACACGCACAGCAGGAAGA<br>AGAGGCAGCUGUACAGCGCGCUGGCGAACAAG<br>UGCUGCCACGUGGGGGUGCACGAAGAGGAGCCU<br>GGCGAGGUUCUGC | | | |
| Construct 26 | AUGCCCCGGCUGUUCUUCUUCCACCUGCUGGG<br>CGUGUGCCUGCUGCUGAACCAGUUUUCUAGGG<br>CCGUGGCCGACAGCUGGAUGGAGGAGGUCAUC<br>AAGCUCUGCGGCCGCGAGCUCGUCCGCGCCCA<br>GAUCGCCAUCUGCGGCAUGUCCACCUGGUCCA<br>AGCGCUCCCUCUCCCAGGAGGACGCCCCGCAG<br>ACCCCCCGCCCCGUCGCCGAGAUCGUCCCCUC<br>CUUCAUCAACAAGGACACCGAGACCAUCAACA<br>UGAUGUCCGAGUUCGUCGCCAACCUCCCCCAG<br>GAGCUCAAGCUCACCCUCUCCGAGAUGCAGCC<br>CGCCCUCCCCAGCUCCAGCAGCACGUCCCCG<br>UCCUCAAGGACUCCUCCCUCCUCUUCGAGGAG<br>UUCAAGAAGCUCAUCCGCAACCGCCAGUCCGA<br>GGCCGCCGACUCCUCCCCCUCCGAGCUCAAGU<br>ACCUCGGCCUCGACACCCACUCCCGCAAGAAG<br>CGCCAGCUCUACUCCGCCCUCGCCAACAAGUG<br>CUGCCACGUCGGCUGCACCAAGCGCUCCCUCG<br>CCCGCUUCUGC | 5' UTR 1 | 3' UTR 4 | 351 |
| Construct 27 | AUGCCCCGGCUGUUCUUUUUCCACCUGCUGGG<br>CGUGUGCCUGCUGCUGAACCAGUUUUCUAGGG<br>CCGUGGCCGACAGCUGGAUGGAGGAAGUGAUC<br>AAGCUGUGCGGCCGGGAGCUGGUGAGAGCACA<br>GAUCGCCAUCUGUGGCAUGUCCACCUGGAGCG<br>GCUCCAACGGCUCUACCAACGAUUCUAAUGGC<br>AGCACAGGCUCCCAGCUGUACAGCGCCCUGGC<br>CAAUAAGUGCUGUCACGUGGGCUGCACAAAGA<br>GGUCCCUGGCCCGCUUCUGU | 5' UTR 1 | 3' UTR 2 | 352 |
| Construct 28 | AUGCCCCGGCUGUUCUUUUUCCACCUGCUGGG<br>CGUGUGCCUGCUGCUGAACCAGUUUUCUAGGG<br>CCGUGGCCGACAGCUGGAUGGAGGAAGUGAUC<br>AAGCUGUGCGGCCGGGAGCUGGUGAGAGCACA<br>GAUCGCCAUCUGUGGCAUGUCCACCUGGAGCG<br>GCUCCAACGGCUCUACCAACACCUCUAAUGGC<br>GACACAGGCUCCCAGCUGUACAGCGCCCUGGC<br>CAAUAAGUGCUGUCACGUGGGCUGCACAAAGA<br>GGUCCCUGGCCCGCUUCUGU | 5' UTR 1 | 3' UTR 2 | 353 |
| Construct 29 | AUGCCCCGGCUGUUCUUUUUCCACCUGCUGGG<br>CGUGUGCCUGCUGCUGAACCAGUUUUCUAGGG<br>CCGUGGCCGACAGCUGGAUGGAGGAAGUGAUC<br>AAGCUGUGCGGCCGGGAGCUGGUGAGAGCACA<br>GAUCGCCAUCUGUGGCAUGUCCACCUGGAGCG<br>GCUCCAACGGCAAGACCAACACCUCUAAUGGC<br>GACACAGGCUCCCAGCUGUACAGCGCCCUGGC<br>CAAUAAGUGCUGUCACGUGGGCUGCACAAAGA<br>GGUCCCUGGCCCGCUUCUGU | 5' UTR 1 | 3' UTR 2 | 354 |
| Construct 30 | AUGCCCCGGCUGUUCUUUUUCCACCUGCUGGG<br>CGUGUGCCUGCUGCUGAACCAGUUUUCCAGGG<br>CCGUGGCCGACUCUUUGGAUGGAGGAAGUGAUC<br>AAGCUGUGCGGCCGGGAGCUGGUGAGAGCACA<br>GAUCGCCAUCUGUGGCAUGUCUACCUGGUCUG<br>GCAGCACAAACUCCGGCUCUACCAGCUCCGGC<br>AACAGCGGCUCCGGCAAUUCUGGCAGCCAGCU<br>GUACAGCGCCCUGGCCAAUAAGUGCUGUCACG<br>UGGGCUGCACAAAGAGGGUCCCUGGCCCGCUUC<br>UGU | 5' UTR 1 | 3' UTR 2 | 355 |
| Construct 31 | AUGCCCCGGCUGUUCUUUUUCCACCUGCUGGG<br>CGUGUGCCUGCUGCUGAACCAGUUUUCCAGGG<br>CCGUGGCCGACUCUUUGGAUGGAGGAAGUGAUC<br>AAGCUGUGCGGCCGGGAGCUGGUGAGAGCACA<br>GAUCGCCAUCUGUGGCAUGUCCACCUGGAGCG<br>GCAGCACAAACUCCGGCUCUGAUACCAGCUCC<br>GGCAACAGCGGCUCCGGCAAUUCUGGCCAGCU<br>GUACAGCGCCCUGGCCAAUAAGUGCUGUCACG<br>UGGGCUGCACAAAGAGGGUCCCUGGCCCGCUUC<br>UGU | 5' UTR 1 | 3' UTR 2 | 356 |
| Construct 32 | AUGCCCCGGCUGUUCUUUUUCCACCUGCUGGG<br>CGUGUGCCUGCUGCUGAACCAGUUUUCUAGGG<br>CCGUGGCCGACUGGAUGGAGGAAGUGAUC<br>AAGCUGUGCGGCCGGGAGCUGGUGAGAGCACA<br>GAUCGCCAUCUGUGGCAUGUCCACCUGGAGCG<br>GCUCCACAAACUCUGGCAGCGAUACCGGCUCU<br>GGCAACUCCAGCGGCAAUAGCGGCCAGCU<br>GUACUCCGCCCUGGCCAAUAAGUGCUGUCACG<br>UGGGCUGCACAAAGAGGAGCCUGGCCCGCUUC<br>UGU | 5' UTR 1 | 3' UTR 2 | 357 |
| Construct 33 | AUGCCCCGGCUGUUCUUUUUCCACCUGCUGGG<br>CGUGUGCCUGCUGCUGAACCAGUUUUCUAGGG<br>CCGUGGCCGACAGCUGGAUGGAGGAAGUGAUC<br>AAGCUGUGCGGCCGGGAGCUGGUGAGAGCACA<br>GAUCGCCAUCUGUGGCAUGUCCACCUGGAGCG<br>GCUCCACAAACUCGGCAGCGACACCUCCGGC<br>AAGAACUCUGGCGAUGGCAAUAGCGGCCAGCU<br>GUACUCCGCCCUGGCCAAUAAGUGCUGUCACG<br>UGGGAUGCACAAAGCGGAGCCUGGCCCGCUUC<br>UGU | 5' UTR 1 | 3' UTR 2 | 358 |
| Construct 34 | AUGCCCCGGCUGUUCUUUUUCCACCUGCUGGG<br>CGUGUGCCUGCUGCUGAACCAGUUUUAGCAGGG<br>CCGUGGCCAGACUCCUGGAUGGAGGAAGUGAUC<br>AAGCUGUGCGGCCGGGAGCUGGUGAGAGCACA<br>GAUCGCCAUCUGUGGCAUGUCUACCUGGUCUG<br>GCAGCACAGACUCCGGCUCUGAUACCAGCUCC<br>GGCAACAGCGGCGAUGGCAAUUCCGGCCAGCU<br>GUACUCGCCCUGGCCAAUAAGUGCUGUCACG<br>UGGGCUGCACAAAGAGGAGCCUGGCCCGCUUC<br>UGU | 5' UTR 1 | 3' UTR 2 | 359 |
| Construct 35 | AUGCCCCGGCUGUUCUUUUUCCACCUGCUGGG<br>CGUGUGCCUGCUGCUGAACCAGUUUUCCAGGG<br>CCGUGGCCGACUCUUUGGAUGGAGGAAGUGAUC<br>AAGCUGUGCGGCCGGGAGCUGGUGAGAGCACA<br>GAUCGCCAUCUGUGGCAUGUCUACCUGGAGCG<br>GCAGCUCCGGCUCUACAAACGAUUCCAAUGGC<br>UCUACCGGCACAGGCAGCGACGGCUCCACCAA<br>CGGCUCUGAUGGCAGCACAGGAGGACAGCUGU<br>ACAGCGCCCUGGCCAAUAAGUGCUGUCACGUG<br>GGAUGCACCAAGAGGUCCCUGGCCCGCUUCUG<br>U | 5' UTR 1 | 3' UTR 2 | 360 |
| Construct 36 | AUGCCCCGGCUGUUCUUUUUCCACCUGCUGGG<br>CGUGUGCCUGCUGCUGAACCAGUUUAGCAGGG<br>CCGUGGCAGACUCUUGGAUGGAGGAAGUGAUC<br>AAGCUGUGCGGCCGGGAGCUGGUGAGAGCACA<br>GAUCGCCAUCUGUGGCAUGAGCACCUGGUCCG<br>GCUCUACAAACAGCGGCUCCGACACCAGCUCC<br>GGCUCCACAAAUUCUGGCAGCGAUACCCUCUAG<br>CGGCAACUCCUGGCAAUAGCGGCUCCCA<br>AGGGCACCGGCUCUGAUGGCAGCACAAACGGC<br>UCCAAUGGCUCUACCGGAGGACAGCUGUACUC<br>UGCCCUGGCCAAUAAGUGCUGUCACGUGGGCU<br>GCACAAAGAGGUCCCUGGCCCGCUUCUGU | 5' UTR 1 | 3' UTR 2 | 361 |
| Construct 37 | AUGCCCAGGCUGUUCUUUUUCCACCUGCUGGG<br>CGUGUGCCUGCUGCUGAACCAGUUUUCCCGCG<br>CCGUGGCAGACUCUUUGGAUGGAGGAAGUGAU<br>CAAGCUGUGCGGCCGGGAGCUGGUGAGAGCAC | 5' UTR 1 | 3' UTR 2 | 362 |

TABLE 7-continued

RNA Sequences

| Name | Sequence | 5' UTR | 3' UTR | SEQ ID NO: |
|---|---|---|---|---|
| | AGAUCGCCAUCUGUGGCAUGUCUACCUGGAGC AAGCGGUCCCUGUCUCAGGAGGAGCGCCCCUCA GACACCUAGACCAGUGGCCGAGAUCGUGCCCA GCUUCAUCAACAAGGAUACCGAGACAAUCAAU AUGAUGUCCGAGUUCGUGGCCAAUCUGCCUCA GGAGCUGAAGCUGACCCUGUCCGAGAUGCAGC CAGCCCUGCCACAGCUGCAGCAGCACGUGCCA GUGCUGAAGGAUAGCUCCCUGCUGUUUGAGG AGUUCAAGAAGCUGAUCCGGAACAGACAGUCC GAGGCCGCCGACUCUAGCCCUUCUGAGCUGAA GUACCUGGAUGAUACCCACAGCAGGAAGA AGCGCCAGCUGUAUUCCGCCCUGGCCAAUAAG UGCUGUCACGUGGGCUGCACAAAGAGGUCCCU GGCCCGCUUUGUGGCGGCGGCGGCUCUGGAG GAGGAGGCAGCGGCGGAGGAGGCUCUGGAG GCGGUCCGUGGAGUGCCCACCUUGUCCAGCAC CACCAGUGGCAGGCCCUAGCGUGUUUCUGUUC CCUCCAAAGCCAAAGGACACCCUGAUGAUCUC UAGGACCCCCGAGGUGACAUGCGUGGUGGUGG ACGUGAGCCACGAGGACCCUGAGGUGCAGUUC AACUGGUACGUGGAUGGCAUGGAGGUGCACA AUGCCAAGACAAAGCCCCGGGAGGAGCAGUUU AACAGCACCUUCAGUGUGGUGUCCGUGCUGAC AGUGGUGCACCAGGACUGGCUGAACGGCAAGG AGUAUAAGUGCGCCGUGUCCAAUAAGGGCCUG CCAGCACCUAUCGAGAAGACCAUCUCUAAGAC AAAGGGCCAGCCUCAGGGAGCCACAGGUGUACA CCCUGCCCCCUUCCCGCGAGGAGAUGACCAAG AACCAGGUGUCUCUGACAUGUCUGGUGAAGG GCUUUUAUCCCUCUGACAUCGCCGUGGAGUGG GAGAGCAAUGGCCAGCCUGAGAACAAUUACAA GACCACACCACCCAUGCUGGACUCCGAUGGCA GCUUCUUCCUGUAUUCUAAGCUGACAGUGGAU AAGAGCCGGUGGCAGCAGGGCAACGUGUUCAG CUGUUCCGUGAUGCACGAGGCCCUGCACAAUC ACUACACCCAGAAGUCUCUGAGCCUGUCCCCC GGCAAGGGCAAGCCAAUCCCCAACUCUCUGCU GGGGCCUGGAUAGCACACACCACCACCACCAC AC | | | |
| Construct 38 | AUGCCUAGGCUGUUCUUUUUCCACCUGCUGGG CGUGUGCCUGCUGCUGAACCAGUUUUCUCGCG CCGUGGCAGACAGCUGGAUGGAGGAAGUGAU CAAGCUGUGCGGCGGACCGGGAGCUGGUGCGCAC AGAUCGCCAUCUGUGGCAUGAGCACCUGGUCC AAGCGGAGCCUGAGCCAGGAGGACGCACCACA GACACCCAGACCUGUGGCCGAGAUCGUGCCUU CCUUUAUCAACAAGGAUACCGAGACAAUCAAU AUGAUGUCUGAGUUCGUGGCCAAUCUGCCCCA GGAGCUGAAGCUGACCCUGUCCGAGAUGCAGC CAGCCCUGCCACAGCUGCAGCAGCACGUGCCU GUGCUGAAGGAUAGCUCCCUGCUGUUUGAGG AGUUCAAGAAGCUGAUCCGGAACAGACAGUCC GAGGCCGCCGACUCUAGCCCAUCUGAGCUGAA GUACCUGGGCCUGGAUACCCACAGCAGGAAGA AGCGCCAGCUGUAUUCCGCCCUGGCCAAUAAG UGCUGUCACGUGGGCUGCACAAAGAGCGGUCCCU GGCCAGAUUUGUGGCGGCGGCGGCUCUGGAG GAGGAGGCAGCGGCGGAGGAGGCUCUGACAUC CAGAUGACCCAGAGCCCUUCCUCUCUGUCCGC CUCUGUGGGCGAUCGGGUGACCAUCACAUGCA GGGCCAGCCGGCCCAUCGGCACAAUGCUGAGC UGGUAUCAGCAGAAGCCUGGCAAGGCCCCAAA GCUGCUGAUCCUGGCCUUCUCUAGGCUGCAGA GCGGCGUGCCCUCCCGGUUCUCCGGCUCCGGA UCUGGCACCGACUUCACCCUGACAAUCAGCUC CCUGCAGCCAGAGGAUUUUGCCACCUACUAUU GUGCCCAGGCCGGCACACACCCCACCACAUUC GGCCAGGGCACAAAGGUGGAGAUCAAGAGGG GCAAGCCAAUCCCCAACCCUCUGCUGGGGCCUG GACAGCACACACCACCACCACCACCAC | 5' UTR 1 | 3' UTR 2 | 363 |
| Construct 39 | AUGCCUCGACUGUUCUUUUUCCACCUGCUGGGG CGUGUGCCUGCUGCUGAACCAGUUUUAGCCGGG | 5' UTR 1 | 3' UTR 2 | 364 |
| 39 | CCGUCGCCGAUAGUUGGAUGGAGGAAGUGAU CAAGCUGUGCCGCCGGGAGCUGGUGAGAGCAC AGAUCGCCAUCUGUGGCAUGUCCACCUGGUCU GGCAGCUCCGGAGGAGGCUCUGGCUCUAGCUC CGGCUCUAGCGGCAGCGGCGGCUCCGGCCAGC UGUACAGCGCUCUGGCUAAUAAGUGUUGUCAC GUCGGAUGUACUAAACGAAGUCUGGCUAGAU UUUGC | 1 | 2 | |
| Construct 40 | AUGCCUCGCCUGUUUUUUUUCCACCUGCUAGG AGUCUGUUUACUACUGAACCAAUUUUCCAGAC CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGUCUGAAGCUCAGGAAGAUGCUCCCUCA GACACCUAGACCAGUGGCAGAAAUUGUGCCAU CCUUCAUCAACAAAGAUACAGAAACCAUAAAU AUGAUGUCAGAAUUUGUUGCUAAUUUGCCAC AGGAGCUGAAGUUAACCCUGUCUGAGAUGCA GCCAGCAUUACCACAGCUACAACAACAUGUAC CUGUAUUAAAAGAUUCCAGUCUUCUCUUUGA AGAAUUUAAGAAACUUAUUCGCAAUAGACAA AGUGAAGCCGACAGCAGUCCUUCAGAAUU AAAAUACUUAGGCUUGGAUACUCAUUCUCGA AAAAAGAGACAACUCUACAGUGCAUUGGCUA AUAAAUGUUGCCAUGUUGGUUGUACCAAAAG AUCUCUUGCUAGAUUUUGC | 5' UTR 1 | 3' UTR 2 | 365 |
| Construct 41 | AUGGGCGUGAAAGUGCUGUUUGCGCUGAUUU GCAUUGCGGUGGCGGAAGCGGACUCAUGGGAU GGAGGAAGUUAUUAAAUUAUGCGGCCGCGAAA UUAGUUCGCGCGCAGAUUGCCAUUUGCGGCAU GAGCACCUGGAGCAAAAGGUCUCUGAGCCAGG AAGAUGCUCCUCAGACACCUAGACCAGUGGCA GAAAUUGUGCCAUCCUUCAUCAACAAAGAUAC AGAAACCAUAAAUAUGAUGUCAGAAUUUGUU GCUAAUUUGCCACAGGAGCUGAAGUUAACCCU GUCUGAGAUGCAGCCAGCAUUACCACAGCUAC AACAACAUGUACCUGUAUUAAAAGAUUCCAG UCUUCUCUUUGAAGAAUUUAAGAAACUUAUU CGCAAUAGACAAAGUGAAGCCGCAGACAGCAG UCCUUCAGAAUUAAAAUACUUAGGCUUGGAU ACUCAUUCUCGAAAAAAGAGACAACUCUACAG UGCAUUGGCUAAUAAAUGUUGCCAUGUUGGU UGUACCAAAAGAUCUCUUGCUAGAUUUUGC | 5' UTR 1 | 3' UTR 2 | 366 |
| Construct 42 | AUGGGCGUGAAAGUGCUGUUUGCGCUGAUUU GCAUUGCGGUGGCGGAAGCGGACUCAUGGGAU GGAGGAAGUUAUUAAAUUAUGCGGCCGCGAAA UUAGUUCGCGCGCAGAUUGCCAUUUGCGGCAU GGAGCCCAAGAGCAGCGACAAGACCCACACCA GCCCCCCAGCCCCGCCCCCCCGAGCUGCUGGGC GGCAGCAGCGUGUUCCUGUUCCCCCCCAAGCC CAAGGACACCCUCUACAUCACCAGGGAGCCCG AGGUGACCUGCGUGGUGGUGGACGUGAGCCAC GAGGACCCGGAGGUGAAGUUCAACUGGUACGU GGACGGCGUGGAGGUGCACAACGCCAAGACCA AGCCCAGGGAGGAGCAGUACAACAGCACCUAC AGGGUGGUGAGCGUGCUGACCGUGCUGCACCA GGACUGGCUGAACGGCAAGGAGUACAAGUGC AAGGUGAGCAACAAGGCCCUGCCCGCCCCCAU CGAGAAGACCAUCAGCAAGGCCAAGGGCCAGC CCAGGGAGCCCCAGGUGUACACCCUGCCCCCC AGCAGGGACGAGCUGACCAAGAACCAGGUGAG CCUGACCUGCCUGGUGAAGGGCUUCUACCCCA GCGACAUCGCCGUGGAGUGGGAGAGCAACGGC CAGCCCGAGAACAACUACAAGACAACCCCCCC CGUGCUGGACAGCGACGGCAGCUUCUUCCUGU ACAGCAAGCUGACCGUGGACAAGAGCAGGUGG CAGCAGGGCAACGUGUUCAGCUGCAGCGUGAU GCACGAGGCCCUGCACAACCACUACACCCAGA AGAGCCUGAGCCUGAGCCCCGGCAAGAGGAAG AGCACCUGGAGCAAAAGGUCUCUGAGCCAGGA AGAUGCUCCUCAGACACCUAGACCAGUGGCAG | 5' UTR 1 | 3' UTR 2 | 367 |

TABLE 7-continued

RNA Sequences

| Name | Sequence | 5' UTR | 3' UTR | SEQ ID NO: |
|---|---|---|---|---|
| | AAAUUGUGCCAUCCUUCAUCAACAAAGAUACA GAAACCAUAAAUAUGAUGUCAGAAUUUGUUG CUAAUUUGCCACAGGAGCUGAAGUUAACCCUG UCUGAGAUGCAGCCAGCAUUACCACAGCUACA ACAACAUGUACCUGUAUUAAAAGAUUCCAGUC UUCUCUUUGAAGAAUUUAAGAAACUUAUUCG CAAUGACAAAGUGAAGCCGCAGACAGCAGUC CUUCAGAAUUAAAAUACUUAGGCUUGGAUAC UCAUUCUCGAAAAAGAGACAACUCUACAGUG CAUUGGCUAAUAAAUGUUGCCAUGUUGGUUG UACCAAAAGAUCUCUUGCUAGAUUUUGC | | | |
| Construct 43 | AUGGGCGUGAAAGUGCUGUUUGCGCUGAUUU GCAUUGCGGUGGCGGAAGCGGACUCAUGGAU GGAAGAGGUAUAUUAAAUUAAUGGAUGGAA UUGGUGCGUGCACAAAUAGCUAUUUGCGGCA UGGGCGGUGGCGGCUCUGGUGGCGGCGGCUCU GGAGGGGGCGGAAGUGGUGGAGGAGGUAGUG GCGCAGGUGGAUCGGGAGGCGGGAGGAUCUGG AGGGGGGGGCUCCUUUCAAAGCUCCUCGAGCA AAGCGCCCCUCCCAGCCUGCCCAGCCCUAGU AGGCUGCCCGGUCCGAGCGACACGCCCAUCCU GCCCCAGGGUGGCGGGCUCUGGGGGUGGCG GUUCAGGCGGAGGUGGUUCUGGCGGAGGCGG AUCAGGUGGUGGGGAUCCGGCGGCGGCGGA UCUGGUGGCGGGGGGAGUCAGCUCUACUCUGC GUUGGCCAAUAAAUGCUGCCAUGUUGGUUGU ACAAAAGAUCUUUGGCUAGAUUUUGC | 5' UTR 1 | 3' UTR 2 | 368 |
| Construct 44 | AUGGGCGUGAAGGUGCUGUUCGCACUGAUCU GCAUCGCCGUGGCCGAGGCCGACAGCUGGAUG GAGGAGGUGUACAAGCUGGUGCGGCAGAGAGC UGGUGAGAGCCCAGAUCGCCAUCUGCGGCAUG AGCACCGGAGCGAGCCCAAGAGCAGCGACAA GACCCCACACCAGCCCCCCCAGCCCCGCUCCCGA GCUGCUGGGCGGCAGCAGCAGCGGCCCCAGCGUGUUCCUGUCC CCCCCAAGCCCAAGGACACCCUGUACAUAACC AGAGAGCCAGAGGUGACCUGCGUGGUGGUGG ACGUGAGCCACGAGGACCCCGAGGUGAAGUUC AACUGGUACGUGGACGGCGUGGAGGUGCACA ACGCCAAGACAAAGCCCAGAGAGGAGCAGUAC AACAGCACCUACAGAGUGGUGAGCGUGCUGAC CGUGCUGCACCAGGACUGGCUGAACGGCAAGG AGUAUAAGUGCAAGGUGUCCAACAAGGCCCU GCCCGCCCCCAUCGAGAAGACCAUCAGCAAGG CCAAGGGCCAGCCCAGAGAGCCCCAGGUGUAC ACCCUGCCCCCAGCAGAGACGAGCUGACCAA GAACCAGGUGAGCCUGACCUGCCUGGUGAAGG GCUUCUACCCCAGCGACAUCGCCGUGGAGUGG GAGAGCAACGGCCAGCCCGAGAACAACUACAA GACCACCCCCCCCGUGCUGGACAGCGACGGCA GCUUCUUCCUGUACAGCAAGCUGACCGUGGAC AAGAGCAGAUGGCAGCAGGGCAACGUGUUCA GCUGCAGCGUGAUGCACGAGGCCUUACACAAC CACUACACCCAGAAGAGCCUAAGCCUGAGCCC CGGCAAGAGAAAGAGAAGAAGUCUGAGCCAG GAGGAGCCCCCCAGACCCCAGACCCGUGGCC CGAGAUCGUGCCCUCCUUCAUUAACAAGGACA CCGAGACCAUCAACAUGAUGAGCGAGUUCGUG GCCAACCUGCCCCAGGAGCUGAAGCUGACCCU GAGCGAAAUGCAACCCGCCCAGAGCCUGCUC AACAGCACGUGCCCGUGCUGAAGGACAGCAGC CUGCUGUUCGAGGAGUUCAAAAGCUGAUCA GAAACAGACAGAGCGAGGCCGCCGACUCCAGC CCCGAGCUGGAAGUACCUCGGCCUGGACC CCACAGCAGAAGAAGAGACAGCUGUACAGCG CCCUGGCCAACAAGUGCUGCCACGUGGGCUGC ACCAAGAGAAGCCUGGCCAGAUUCUGC | 5' UTR 1 | 3' UTR 1 | 369 |
| Construct 45 | AUGGGAGUUAAAGUGCUUUUUGCGCUUAUUU GUAUUGCGGUCGCGGAGGCUGACUCAUGGAU GGAAGAGGUCAUUAAGCUCUGUGGAAGGGAA CUCGUUAGAGCCCAAAUAGCUAUUUGCGGGAU GAGUACAUGGUCCGGUGGGGGUGGUUCGGGU | 5' UTR 1 | 3' UTR 1 | 370 |
| | GGAGGUGGGUCGGGAGGAGGAGGCUCCGGUG GAGGCGGCCAGUGGGGCGGAGGGUCCGGUGG GGGUGGGUCUGGAGGAGGUGGUUCGUUUCAG UCUUCAUCUUCCAAAGCUCCUCCUCCCUUCGCU UCCCAGCCCUAGCAGGCUUCCAGGUCCAUCAG AUACUCCAAUAUUGCCCCAGGGAGGGGUGGA UCAGGAGGAGGAGGGAGUGGUGGGGGAGGAU CUGGUGGAGGUGGUUCCGGAGGAGGAGGAAG CGGGGGGGGAGGUUCAGGCGGUGGUGGAAGC CAACUGUAUAUGUGCGUUUGGCUAACAAAUGUU GUCAUGUCGGAUGUACUAAAAGGAGCCUCGCC AGGUUUUGC | | | |
| Construct 46 | AUGGGCGUGAAAGUGCUGUUUGCGCUGAUUU GCAUUGCGGUGGCGGAAGCGGACUCAUGGAU GGAGGAAGUUAUUAAAUUAUGCGGCCGGAA UUAGUUCGCGCGCAGAUUGCCAUUUGCGGCAU GAGCACCGGAGCAAAAGGUCUCUGAGCCAGG AAGAUGCUCCUCAGACACCUAGACCAGUGGCA GAAAUUGUGCCAUCCUUCAUCAACAAAGAUAC AGAAACCAUAAAUAUGAUGUCAGAAUUUGUU GCUAAUUUGCCACAGGAGCUGAAGUUAACCCU GUCUGAGAUGCAGCCAGCAUUACCACAGCUAC AACAACAUGUACCUGUAUUAAAAGAUUCCAG UCUUCUCUUUGAAGAAUUUAAGAAACUUAUU CGCAAUAGACAAAGUGAAGCCGCAGACAGCAG UCCUUCAGAAUUAAAAUACUUAGGCUUGGAU ACUCAUUCUCGAAAAAGAGACAACUCUACAG UGCAUUGGCUAAUAAAUGUUGCCAUGUUGGU UGUACCAAAAGAUCUCUUGCUAGAUUUUGC | 5' UTR 1 | 3' UTR 1 | 371 |
| Construct 47 | AUGAGCAGCAGACUGCUGCUGCAGCUGCUGGG CUUCUGGCUGUUCCUGAGCCAGCCCUGCAGAG CCAGAGUGAGCGAGGAGUGGAUGGACCAGGU GAUCCAGGUGUGCGGCAGAGGCUACGCCAGAG CCUGGAUCGUGGAUGUGCGCCCCAGCCUGGUGGG CAGACUGGCCCUGAGCCAGGAGGAGCCCGCCCC CCUGGCCAGACAGGCCACCGCCGAGGUGUGCC CAGCUUCAUCAACAAGGACGCCGAGCCCUUC GACAUGACCCUAGAGCCUGCCAACCUGAG CGAGGAGAGAAAGGCCGCCCUGAGCGAGGGCA GAGCCCCCUUCCCCGAGCUGCAGCAGCACGCC CCCGCCCUGAGCGACAGCGUGGUGACUGGA GGGCUUCAAGAAGACCUUCCACAACCAGCUGG GCGAGGCCGAGGACGGCGGCCCCCCCGAGCUG AAGUACCUGGGCAGCGACCCCCAGAGCAGAAA GAAGAGACAGAGCGGCGCCCUGCUGAGCGAGC AGUGCUGCCACAUCGGCUGCACCAGAAGAAGC AUCGCCAAGCUGUGC | 5' UTR 1 | 3' UTR 2 | 372 |
| Construct 48 | AUGGGGGUGAAGGUGCUGUUCGCCCUCAUCUG CAUAGCGGUGGCCGAGGCCGACUCUUGGAUGG AGGAGGUGAUCAAGCUCUGCGGCAGGGAGCUC GUGCGUGCCCAGAUCGCGAUCUGCGGCAUGAG CACCGGUCAGAGCCAAAGAGCAGCGAUAAGA CGCAUACCAGCCCUCCCAGCCCGCCCCCGAG CUGCUGGGCGGCAGCAGCGGCCCCAGCGUGUUCCUCUUCCC ACCCAAGCCCAAGGACACCCUCUACAUCACCC GCGAGCCCGAGGUGACGUGCGUGUGGUGGAC GUGUCCCACGAGGACCCCGAGGUCAAGUUCAA CUGGUACGUGGACGGCGUGGAGGUCCACAACG CCAAGACCAAGCCUCGGGAGGAGCAGUACAAC AGCACCUACAGGGUGGUGAGCGUCCUGACAGU CCUGCACCAGGACUGGCUGAAUGGCAAGGAAU ACAAGUGCAAGGUCAACAAGGCCCUGCCCGC GCCCCAUCGAGAAAACCAUCAGCAAGGCCCAA GGGCCAGCCACGUGAGCCCCAGGUGUACACCC UGCCCCCCAGCAGGGACGAGCUCACCAAGAAC CAGGUGAGCCUGACCUGCCUGGUGAAAGGUUU CUACCCUUCGAUCGCGGUUGAGUGGGAGA GCAAUGGCCAACCCGAGAACAACUACAAGACA ACCCCGCCCGUGCUGGACUCCGAUGGGAGCUU CUUCCUGUAUAGCAAGCUGACCGUGGACAAGA GCCGCUGGCAGCAGGGCAACGUGUUCAGCUGC | 5' UTR 1 | 3' UTR 1 | 373 |

TABLE 7-continued

RNA Sequences

| Name | Sequence | 5' UTR | 3' UTR | SEQ ID NO: |
|---|---|---|---|---|
| | UCCGUCAUGCACGAGGCCCUGCAUAACCACUA CACCCAAAAGAGCCUGUCCCUGAGCCCCGGCA AGCGCAAGAAGAGGUCCCUGAGCCAAGAAGAC GCCCCGCAGACGCCCAGGCCCGUGGCCGAGAU CGUGCCCAGCUUCAUCAACAAGGAUACCGAGA CAAUCAACAUGAUGCGGAAUUUGUGGCUAA CCUGCCCAAGAGCUGAAACUGACCCUGUCGG AAAUGCAGCCCGCGCUGCCGCAGCUGCAGCAG CACGUGCCGGUGCUGAAGGAUAGCAGCUUGCU GUUCGAGGAAUUCAAGAAGCUCAUCCGUAAUC GACAGAGCGAGGCGGCCGAUUCCAGCCCCAGC GAGCUGAAGUAUCUGGGGCUGGAUACCCACAG CCGCAAGAAGCGGCAGCUGUACUCUGCUCUGG CCAAUAAGUGUUGCCACGUCGGCUGCACCAAA CGCAGCCUGGCCAGGUUCUGC | | | |
| Con-struct 49 | AUGGGCGUCAAGGUCCUCUUCGCCCUUAUCUG CAUCGCCGUGGCCGAGGCCGACAGCUGGAUGG AGGAGGUGAUCAAGCUUUGCGGCCGGGAGCU UGUGCGCGCGCAGAUCGCCAUUUGCGGCAUGA GCACCUGGUCCGAACCAAAGAGCUCCGACAAG ACCCACACCUCCCCUCCCUUCCCCCGCCCCGAG CUGCUGGGCGGCAGCAGCGUCUUUCUGUUCCC GCCCAAGCCCAAGGACACCCUGUACAUCACCA GGGAGCCCGAGGUGACAUGUGUCGUGGUGGA CGUGUCACACGAGGACCCCGAGGUGAAGUUCA ACUGGUACGUCGACGGCGUGGAGGUGCACAAC GCAAAAACCAAGCCCCGGGAGGAACAGUACAA CAGCACCUACCGGGUGGUCAGCGUGCUGACCG UGCUCCAUCAGGACUGGCUGAACGGCAAGGAG UACAAAUGCAAGGUCAGCAACAAAGCCCUGCC CGCCCCAAUCGAAAAGACCAUCUCCAAGGCCA AGGGGCAGCCCAGGGAACCCCAGGUGUACACC CUGCCCCCAGCAGGGACGAGCUCACCAAGAA CCAGGUGAGCCUGACCUGCCUGGUGAAGGGGU UCUACCCCAGCGACAUCGCCGUGGAGUGGGAA AGCAACGGCCAACCCGAAAACAACUACAAGAC CACCCCGCCGGUGCUGGACUCUGACGGCAGCU UCUUCCUCUACAGCAAGCUGACCGUUGACAAA UCCAGGUGGCAACAGGGCAACGUCUUCAGCUG CAGCGUGAUGCAUGAAGCGCUGCACAACCAUU ACACGCAGAAAAGCCUGUCCCUGAGCCCCGGC AAGAGGAAGAAAAGGAGCCUGUCCCAGGAGG ACGCCCCUCAGACCCCGCACCUGGCCGAG AUCGUGCCUAGCUUCAUUAACAAGGACACCGA GACGAUCAACAUGAUGAGCGAGUUCGUGGCCA AUCUGCCCCAGGAGCUGAAGCUCACCCUCAGC GAGAUGCAGCCCGCCCUGCCCCAGCUGCAGCA GCACGUCCCGGUCCUGAAGGACAGCAGCCUGC UGUUCGAGGAGUUCAAGAAGCUGAUCAGGAA CAGGCAGAGCGAGGCCGCCGACUCCUCCCCCU CCGACGUGAAGUACCUGGGCCUGGACACCCAC UCCAGGAAGAAGCGGCAGCUGUACUCAGCCCU GGCCAACAAGUGCUGCCACGUGGGCUGCACCA AGCGGAGCCUGGCCCGGUUCUGC | 5' UTR 1 | 3' UTR 1 | 374 |
| Con-struct 50 | AUGGGCGUGAAGGUGCUGUUCGCCCUCAUCUG CAUCGCCGUGGCCGAGGCCGACAGCUGGAUGG AGGAGGUGAUCAAACUCUGCGGCAGGGAGCUC GUGCGCGCCCAGAUCGCCAUCUGCGGGAUGUC CACCUGGAGCGAGCCCAAGAGCUCCGACAAAA CCCACACCAGCCCGCCCAGCCCAGCCCCGAGC UGCUGGGCGGCAGCAGCGUGUUCCUCUUCCCU CCCAAGCCCAAGGACACGCUGUACAUCACCCG GGAGCCCGAGGUGACGUGCGUGGUGGUGGAC GUGAGCCACGAGGACCCUGAAGUGAAGUUUAAC UGGUAUGUUGACGGCGUGGAGGUGCACAACG CAAAGACCAAGCCCCGCGAGGAGCAGUACAAC AGCACCUACCGCGUCGUGAGCGUGCUGACCGU CCUCCACCAGGAUUGGCUGAACGGCAAGGAGU ACAAGUGCAAGGUGUCCAACAAGGCCCUGCCC GCCCCGAUCGAGAAGACCAUUAGCAAGGCCAA GGGCCAGCCCAAGGGAGCCACAAGUGUACACCC UGCCACCUUCCAGGGACGAGCUGACCAAGAAU | 5' UTR 1 | 3' UTR 1 | 375 |
| | CAGGUCAGCCUGACCUGCCUGGUUAAGGGCUU CUACCCAAGCGACAUCGCCGUUGAGUGGGAGA GCAACGGACAGCCUGAGAACAACUAUAAGACU ACCCCUCCCGUGCUGGAUUCCGACGGAAGCUU CUUCCUGUACAGCAAGCUGACCGUGGACAAGA GCAGAUGGCAGCAGGGUAACGUGUUUUCCUGC UCCGUGAUGCAUGAGGCCCUGCACAACCACUA CACCCAGAAAAGCCUCAGCCUGAGCCCCGGCA AACGCAAGAAGCGGAGCCUGUCGCAAGAGGAC GCCCCCCAGACCCCCAGGCCUGUGGCCGAGAU CGUCCCCAGCUUCAUCAACAAGGACACCGAGA CUAUCAACAUGAUGAGCGAAUUCGUGGCCAAC CUCCCCCAGGAACUGAAGCUGACCCUGAGCGA GAUGCAGCCCGCCCUGCCCCAGCUGCAGCAGC ACGUGCCCGUACUGAAGGACAGCUCCCUGCUG UUUGAAGAGUUUAAGAAGCUGAUCCGGAACA GGCAGUCCGAAGCCGCCGACAGCUCCCCCAGC GAGCUGAAAUACCUGGGGCUGGACACCCACAG CCGGAAAAAGCGCCAGCUGUACAGCGCCCUGG CGAACAAGUGCUGCCACGUGGGCUGCACCAAG CGUUCCCUGGCCCGGUUUUGC | | | |
| Con-struct 51 | AUGGGCGUGAAGGUCCUCUUCGCCCUCAUCUG CAUCGCCGUGGCCGAGGCCGACUCCUGGAUGG AGGAGGUGAUAAAGCUCUGCGGCAGGGAGCU CGUGCGCGCCCAAAUCGCCAUCUGCGGGAUGA GCACCUGGAGCGAGCCCAAGAGCUCCGACAAG ACACACACCUCCCCGCCCAGCCCCGCCCCAGA GCUGCUGGGCGGGAGCAGCGUCUUUCUGUUCC CGCCCAAGCCCAAGGACACCCUGUACAUCACG CGCGAGCCCGAAGUGACCGUGGUCGUGGA CGUGAGCCACGAGGACCCUGAGGUGAAGUUCA ACUGGUACGUGGACGGCGUGGAGGUGCACAAC GCUAAGACCAAGCCCCGGGAGGAGCAGUACAA CUCAACCUACAGAGUGGUGAGCGUCCUCACGG UGCUGCACCAGGAUUGGCUGAAUGGCAAGGA GUAUAAAUGCAAGGUGAGCAACAAAGCACUG CCCGCCCCCAUCGAGAAGACAAUCUCUAAGGC CAAGGGCCAGCCCAGGGAGCCCCAGGUGUACA CCCUGCCCCCAAGAGACGAGCUGACCAAGAA AAUCAGGUGUCCCUGACCUGCCUCGUGAAGGG CUUCUACCCCAGCGAUAUCGCUGUGGAGUGGG AGUCCAACGGGCAGCCGGAGAACAACUACAAG ACCACCCCCCUCGUGCUGGACAGCGACGGGA CUUUUUCCUGUACAGCAAGCUGACCGUCGACA AGAGCAGAUGGCAGCAGGGCAACGUGUUCAGC UGCAGCGUCAUGCACGAGGCCCUGCACAACCA CUACACACAAAAGAGCCUGAGCCUGUCGCGCA GCAAGCGAAAGAAGAGAAGCUUGAGCAGGA GGACGCCCCCAGACCCCCGGCCCGUGGCCG AGAUCGUGCCCAGCUUCAUCAACAAGGACACC GAGACUAUUAACAUGAUGAGCGAGUUCGUGG CCAAUCUGCCCCAGGAGCUCAAACUUACCCUG UCCGAGAUGCAGCCCGCCCUGCCCCAGCUGCA GCAGCACGUGCCCGUGCUGAAGGACAGUUCCC UGCUCUUCGAGGAGUUCAAAAAGCUGAUCCGC AACAGACAGAGCGAGGCCGCCGAUAGCAGCCC CUCCGAGCUGAAGUACCUCGGCCUGGACACCC ACAGCAGGAAGAAGAGGCAGCUGUACAGCGCC CUGGCCAAUAAGUGCUGUCACGUUGGCUGCAC CAAGCGCAGCCUCGCCCGGUUUUGC | 5' UTR 1 | 3' UTR 1 | 376 |
| Con-struct 52 | AUGGGCGUGAAGGUGCUGUUCGCCCUCAUCUG CAUUGCCGUGGCCGAAGCCGACAGCUGGAUGG AGGAGGUCAAGCUCUGCGGCAGGGAGCUC GUGAGGGCCCAGAUCGCCAUCUGCGGCAUGAG CACCUGGAGCGAGCCCAAGUCCAGCGACAAGA CCCACACCAGCCCGCCCAGCCCCGCCCCGGAGC UUCUUGGGGCCCAAGCCCAAGGACACCCUGUACAUCACCCG GGAACCCGAGGUGACCUGCGUGGUCGUUGACG UCAGCACGAGGAUCCCGAAGUCAAGUUUAAC UGGUAUGUGGACGGCGUGGAGGUCCACAAUG CCAAAACCAAGCCACGGGAGGAACAGUAUAAU | 5' UTR 1 | 3' UTR 1 | 377 |

TABLE 7-continued

RNA Sequences

| Name | Sequence | 5' UTR | 3' UTR | SEQ ID NO: |
|---|---|---|---|---|
| | UCCACCUACAGGGUGGUCAGCGUGCUCACCGU<br>GCUCCACCAGGACUGGCUCAACGGAAAGGAGU<br>AUAAGUGCAAGGUGAGCAAUAAGGCCCUGCCU<br>GCCCCCAUCGAGAAGACCAUCUCCAAGGCGAA<br>AGGCCAGCCCCGGGAGCCUCAGGUCUACACCC<br>UGCCCCCCAGCCGCGACGAGCUCACCAAGAAC<br>CAGGUGAGCCUCACCUGCCUGGUGAAGGGCUU<br>CUACCCCAGCGACAUCGCCGUGGAGUGGGAGU<br>CCAACGGACAGCCCGAGAACAACUACAAGACC<br>ACCCCACCGGUCCUGGACAGCGAUGGCUCCUU<br>CUUCCUGUACAGCAAACUGACCGUGGACAAGA<br>GCCGGUGGCAGCAGGGCAACGUGUUCAGCUGC<br>AGCGUCAUGCACGAGGCGCUGCACAAUCACUA<br>CACCCAGAAAUCCCUGAGCCUGUCCCCCGGCA<br>AGAGGAAGAAGAGGAGCCUGUCCCCAGGAGGA<br>CGCCCCCCAGACACCCAGGCCCGUGGCCGAGA<br>UCGUGCCCUCCUUCAUCAACAAGGAUACCGAA<br>ACCAUCAACAUGAUGAGCGAGUUCGUAGCCAA<br>CCUGCCGCAGGAGCUCAAGCUGACCCUGAGCG<br>AGAUGCAGCCCGCCCUGCCCAGCUGCAACAG<br>CACGUGCCCGUGCUCAAGGACAGCAGCCUGCU<br>GUUCGAGGAGUUCAAAAAGCUGAUCCGUAACC<br>GCCAGAGCGAGGCCGCCGAUUCUAGCCCCUCC<br>GAGCUGAAGUAUCUGGGACUGGACACCCACUC<br>CCGCAAGAAACGGCAGCUUUAUUCCGCCCUGG<br>CCAACAAGUGCUGCCACGUGGGCUGCACCAAA<br>AGGUCCCUGGCCAGGUUUUGC | | | |
| Con-<br>struct<br>53 | AUGGGCGUGAAAGUGCUCUUUGCCCUCAUCUG<br>CAUCGCCGUGGCCGAGGCCGACAGCUGGAUGG<br>AGGAGGUGAUAAAGCUCUGCGGGCGGGAGCU<br>CGUCCGGGCCCAGAUCGCCAUCUGCGGAUGA<br>GCACCUGGAGCGAGCCCAAGUCCAGCGACAAG<br>ACCCACACCUCGCCCCCAGCCCGGCCCCCGAG<br>CUGCUGGGGGAAGCAGCGUGUUCCUGUUCCC<br>GCCCAAGCCCAAGGACACCCUGUACAUCACAC<br>GAGAGCCCGAAGUUACCUGCGUCGUGGUGGAC<br>GUGAGCCACGAGGACCCCGAGGUGAAGUUCAA<br>UUGGUACGUGGACGGAGUGGAGGUGCACAAU<br>GCAAAAACCAAGCCCCAGAGGAGCAGUACAA<br>UAGCACCUACAGGGUGGUGAGCGUGCUGACUG<br>UGCUGCACCAGGACUGGCUGAACGGGAAGGAG<br>UACAAGUGCAAGGUUAGCAACAAGGCCCUCCC<br>CGCCCCAAUCGAGAAGACCAUCUCCAAGGCUA<br>AGGGCCAGCCCAGGGAGCCCCAGGUCUAUACA<br>CUCCCGCCCAGCAGAGAUGAGCUCACCAAGAA<br>CCAGGUCAGCCUGACCUGUCUGGUGAAAGGCU<br>UCUACCCCAGCGACAUUGCCGUGGAGUGGGAG<br>UCCAACGGCCAGCCCGAGAACAACUACAAGAC<br>CACUCCCCCCGUACUGGAUUCCGACGGCAGCU<br>UCUUCCUGUACAGCAAGCUCACCGUGGACAAA<br>UCCAGGUGGCAGCAGGGCAACGUGUUUUCCUG<br>CAGCGUAAUGCAUGAGGCCCUCCACAACCACU<br>ACACCCAGAAAAGCCUGAGCCUGAGCCCCGGG<br>AAGAGGAAGAAGAGGAGCCUGUCCCAGGAGG<br>ACGCCCCCAGACACCCCAGGCCCGUGGCCGAG<br>AUCGUCCCCAGCUUCAUCAAUAAGGACACGGA<br>GACGAUCAACAUGAUGAGCGAAUUCGUGGCA<br>AACCUCCCCAGGAGCUGAAACUGACGCUGAG<br>CGAGAUGCAGCCAGCCCUGCCUCAGCUGCAGC<br>AACUGUGCCCGUGCUGAAGGACAGCUCCUUG<br>CUGUUCGAGGAAUUCAAGAAGCUGAUCCGGA<br>ACAGGCAGAGCGAGGCCGCCGACUCCAGCCCC<br>UCCGAGCUGAAGUACCUGGGGCUGGACACCCA<br>CUCCCGAAAAAGGUCAGCUGUACAGCGCUU<br>UGGCGAACAAAUGCUGCCAUGUCGGCUGUACC<br>AAGCGGUCCCUGGCCCGCUUCUGC | 5'<br>UTR<br>1 | 3'<br>UTR<br>1 | 378 |
| Con-<br>struct<br>54 | AUGGGGGUGAAGGUCCUCUUCGCGUUGAUCU<br>GCAUCGCCGUGGCCGAGGCAGAUAGCUGGAUG<br>GAGGAGGUUAUCAAGCUCUGUGGGUCGCGAGC<br>UCGUGCGCGCCCAAAUCGCCAUCUGCGGCAUG<br>AGCACCUGGAGCGAGCCGAAAAGCAGCGACAA<br>GACACACACCUCCCCUCCGAGCCCGCUCCCG | 5'<br>UTR<br>1 | 3'<br>UTR<br>1 | 379 |
| | AGCUUCUGGGUGGGUCCUCAGUGUUUCUGUUC<br>CCGCCCAAGCCAAAGGACACGCUGUACAUCAC<br>CAGAGAGCCCGAAGUGACUUGCGUGGUGGUCG<br>ACGUGUCCCACGAGGACCCUGAAGUCAAGUUC<br>AACUGGUACGUGGACGGCGUGGAGGUGCACA<br>ACGCCAAGACAAAGCCCCGGGAGGAACAGUAC<br>AACUCCACCUACCGGGUGGUGUCCGUGCUCAC<br>CGUGCUCCACCAGGACUGGCUGAACGGCAAGG<br>AGUACAAGUGCAAGGUGAGCAACAAGGCUCU<br>GCCCGCCCCCAUCGAGAAGACGAUCUCCAAGG<br>CCAAGGGGCAACCCAGGGAACCGCAGGUCUAU<br>ACCCUGCCCCCCUCUCGGGACGAGCUGACGAA<br>GAACCAGGUUAGCCUCACCUGCUGGUGAAGG<br>GCUUCUACCCCUCCGACAUCGCCGUCGAGUGG<br>GAAUCCAACGGACAGCCUGAGAACAAUUACAA<br>GACCACCCCUCCCGUCCUGGACUCCGACGGCA<br>GCUUCUUUCUCUACUCCAAGCUCACCGUGGAC<br>AAGUCGAGGUGGCAGCAGGGAAACGUGUUCU<br>CCUGUAGCGUGAUGCACGAGGCCCUGCACAAC<br>CACUACACCCAGAAAAGCCUGAGCCUCAGCCC<br>CGGGAAGCGGAAAAAGCGCUCCCUGUCCCAGG<br>AGGACGCCCCCAGACACCCCGGCCCGUGGCC<br>GAGAUCGUCCCUUCCUUCAUCAAUAAGACAC<br>CGAGACAAUCAACAUGAUGAGCGAGUUCGUG<br>GCCAACCUGCCCCAGGAACUGAAGCUGACCCU<br>CUCGGAGAUGCAGCCCGCGCUGCCGCAGCUGC<br>AGCAGCAUGUGCCCGUGCUGAAAGACAGCAGC<br>CUGCUGUUCGAGGAGUUUAAGAAGCUCAUCA<br>GAAAUAGACAGAGCGAGGCCGCCGAUAGCUCC<br>CCAAGCGAGCUCAAGUACCUCGGGCUGGACAC<br>GCACAGCAGAAAGAAGAGACAGCUGUACAGCG<br>CCCUGGCCAAUAAGUGCUGCCACGUCGGCUGC<br>ACCAAGCGGAGCUUGGCGAGGUUCUGC | | | |
| Con-<br>struct<br>55 | AUGGGCGUAAAGGUGCUCUUUGCCCUAAUCUG<br>CAUCGCCGUGGCCGAGGCCGACAGCUGGAUGG<br>AGGAGGUGAUCAAGCUCUGCGGCCGGGAGCUC<br>GUGCGCGCCCAGAUCGCCAUCUGCGGGAUGAG<br>CACCUGGAGCGAGCCCAAAAGUUCCGACAAGA<br>CCCACACCAGCCCCCGCCCCGCCCCCGAGC<br>UGCUGGGAGGGAGCAGCGUGUUCCUGUUCCCA<br>CCCAAGCCCAAGGACACCCUGUACAUCACCCG<br>CGAGCCCGAGGUGACCUGCGUGGUGGUGACG<br>UGUCCCAUGAGGAUCCUGAGGUGAAGUUCAAC<br>UGGUACGUGGACGGCGUGGAGGUGCACAACGC<br>CAAAACCAAGCCCAGGGAGGAGCAGUACAAUU<br>CCACCUACAGGGUGGUGAGCGUCCUGACGGUC<br>CUGCACCAGGACUGGCUGAAUGGCAAGGAGUA<br>CAAGUGCAAGGUGAGCAACAAGGCCCUGCCCG<br>CGCCUAUCGAGAAGACGAUCAGCAAGGCCAAA<br>GGCCAACCGAGGGAGCCCCAGGUGUAUACCCU<br>GCCCCCCAGCAGGGACGAGCUCACCAAGAAUC<br>AAGUGUCACUGACCUGCUGGUGAAGGGCUUC<br>UACCCCUCCGACAUCGCUGUGGAGUGGGAGAG<br>CAACGGCCAGCCCGAAAAUAACUACAAGACCA<br>CCCCGCCCGUGCUGGACAGCGACGGCAGUUUC<br>UUUCUGUACAGCAAGCUGACCGUGGACAAGUC<br>CAGAUGGCAGCAGGGCAACGUGUUCAGCUGUA<br>GCGUCAUGCACGAGGCCCUGCAUAAUCACUAC<br>ACCCAGAAAGCCUGUCCCUGAGCCCAGGGAA<br>GCGGAAGAAGCGCCUCUCCAGCCAGGAGGACG<br>CCCCGCAGACCCCAGACCCGUUGCCGAGAUC<br>GUGCCCUCAUUCAUCAACAAGGACACAGAGAC<br>AAUCAACAUGAUGUCCGAAUUCGUGGCCAACC<br>UCCCCCAGGAACUGAAGCUGACCCUCAGCGAG<br>AUGCAGCCCGCCCUGCCCAGCUGCAGCAGCA<br>UGUGCCCGUGCUGAAGGACUCGAGCCUGCUGU<br>UCGAAGAGUUCAAGAAGCUGAUCAGAAAUCG<br>UCAGUCCGAGGCCGCACAGCCCCCACAGC<br>CGCAAGAAGAGGCAGCUGUACAGCGCCCUGGC<br>CAACAAGUGCUGCCACGUGGGUUGCACCAAGC<br>GCAGCUUGGCCAGGUUUUGC | 5'<br>UTR<br>1 | 3'<br>UTR<br>1 | 380 |

TABLE 7-continued

RNA Sequences

| Name | Sequence | 5' UTR | 3' UTR | SEQ ID NO: |
|---|---|---|---|---|
| Construct 56 | AUGGGCGUGAAGGUGCUGUUCGCCCUCAUUUG UAUCGCCGUGGCCGAAGCGGACAGCUGGAUGG AGGAGGUGAUCAAACUAUGCGGCAGGGAGCU CGUGAGAGCUCAGAUUGCCAUCUGCGGCAUGU CGACCUGGAGCGAGCCCAAGAGCAGCGACAAG ACCCACACCUCCCCGCCCAGCCCCGCCCCGAG CUGCUGGGGGGCAGCAGCGUGUUCCUGUUCCC CCCCAAGCCCAAGGACACCCUGUACAUCACCC GAGAGCCCGAGGUGACCUGUGUGGUGGUGGA CGUUUCCCACGAGGACCCCGAGGUCAAGUUCA ACUGGUACGUGGAUGGCGUGGAGGUGCACAA UGCCAAGACUAAGCCCCGAGAGGAGCAGUACA ACAGCACCUACAGGGUGGUCAGCGUGCUGACC GUCCUGCACCAGGACUGGCUGAACGGGAAGGA AUACAAGUGCAAGGUAAGCAACAAGGCCCUGC CUGCCCCCAUCGAGAAGACCAUUUCCAAGGCC AAGGGCCAACCAAGGGAGCCCCAGGUGUACAC CCUGCCCCCAGCAGAGAUGAACUGACCAAGA ACCAGGUGAGCCUGACCUGCCUGGUCAAGGGG UUCUACCCCUCCGACAUCGCCGUGGAGUGGGA GUCCAACGGCCAGCCCGAGAACAACUACAAGA CCACCCCGCCCGUCCUCGAUAGCGACGGGAGC UUCUUCCUGUACUCAAAGCUAACCGUGGACAA GAGCAGGUGGCAGCAGGGCAACGUGUUCUCCU GCAGCGUGAUGCACGAAGCCCUGCAUAACCAC UAUACCCAGAAGUCCCUGAGCCUGAGCCCCGG AAAGCCAAAAGCGCACCCUGACCCAGGA ACGCCCCACAAACCCCCAGGCCGUGGCCGAG AUCGUGCCCAGCUUCAUCAACAAGGACACUGA GACGAUCAACAUGAUGUCCGAGUUUGUGGCCA ACCUGCCCCAGGAGCUGAAGCUGACCCUGUCU GAGAUGCAGCCCGCCCUGCCUCACUCCAGCC GCACGUGCCCGUCCUCAAGGACAGCAGCCUGC UGUUCGAGGAGUUUAAGAAGCUGAUCCGGAA CAGGCAGUCAGAGGCCGCCGACAGCAGCCCA GCGAGCUGAAGUAGUCCGGCACACAU AGCGGAAGAAGAGGCAGCUCUACAGCGCCCU CGCCAACAAAUGCUGCCACGUGGGCUGCACCA AGAGGAGCCUGGCCAGAUUCUGU | 5' UTR 1 | 3' UTR 1 | 381 |
| Construct 57 | AUGGGCGUGAAGGUCCUCUUCGCCCUCAUCUG CAUCGCCGUGGCCGAGGCCGAUAGCUGGAUGG AGGAGGUCAUCAAGCUCUGCGGGCGAGAGCUC GUGAGAGCCCCAGAUCGCCAUCUGCGGCAUGA CACCUGGAGCGAGCCCAAGUCCUCGACAAGA CGCAUACCAGCCCGCCAGCCCCGCCCCCGAG CUGCUGGGGGGCAGCAGCGUGUUCCUGUUCCC ACCCAAGCCCAAGGACACCCUGUACAUCACCC GGGAACCUGAGGUGACAUGCGUGGUGGUGGA CGUAAGCCACGAGGACCCAGAGGUGAAGUUUA ACUGGUACGUGGACGGGUGGAGGUGCACAA UGCCAAGACCAAGCCUAGGGAGGAGCAAUACA ACUCCACCUACCGCGUGGUGAGCGUGCUGACG GUCCUGCACCAGGACUGGCUGAACGGCAAAGA GUACAAGUGCAAAGUGCCAACAAAGCCCUGC CCGCCCCCAUCGAGAAGACCAUCUCCAAGGCC AAGGGCCAGCCAGAGAGCCCCAGGUGUACAC CCUGCCCCCUCUAGGGACGAGCUCACCAAGA ACCAGGUGAGCCUGACCUGCCUGGUGAAGGGC UUCUACCCCGUCCGACAUCGCCGUGGAGUGGGA GAGCAACGGCCAACCCGAGAACAACUACAAGA CCACCCCGCCGGUGCUCGACUCCGACGGCAGC UUCUUCCUCUACAGCAAGCUAACCGUGGAUAA GAGCCGCUGGCAGCAGGGCAACGUCUUCAGCU GCAGCGUCAUGCACGAGGCCCUGCACAACCAC UACACCCAGAAAAGCCUGUCCCUGUCCCCCGG CAAGCGGAAGAAGAGAUCGCUGUCCAGGAGG ACGCCCCCAAACGCCCAGGCCCGUAGCCGAG AUCGUGCCCUUCAUCAACAAGGACAACUGA GACAAUUAACAUGAUGAGUGAGUUUGUGGCC AAUCUCCCCCAGGAGCUGAAGCUCACCCUGAG CGAGAUGCAGCCCGCCCUCCCCCAGCUGCAGC AGCACGUGCCCGUCCUGAAGGACAGCUCCCUC CUGUUCGAAGAGUUCAAGAAGCUGAUCAGGA | 5' UTR 1 | 3' UTR 1 | 382 |
| | ACCGGCAGAGCGAGGCCGCCGACUCCAGCCCC AGCGAGCUGAAGUACCUGGGCUGGACACCCA CUCCAGGAAGAAGCGGCAGCUGUACAGCGCCC UGGCCAACAAGUGUUGUCACGUCGGUUGCACG AAACGUCGCUCGCCCGGUUUUGU | | | |
| Construct 58 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGAGCCCAAGAGCAGCGACAAG ACCCACACCAGCCCCCAAGCCCCGCUCCCGA GCUGCUGGGCGGCAGCAGCGUGUUCCUGUUCC CUCCUAAACCUAAGGACACCCUGUACAUCACC CGGGAGCCCGAGGUGACCUGCGUGGUGGUGGA CGUGAGCCACGAGGACCCUGAGGUGAAGUUCA ACUGGUACGUGGACGGCGUGGAGGUGCACAAC GCCAAGACCAAGCCACGGGAGGAGCAGUACAA CAGCACCUACCGGGUGGUGAGCGUGCUGACCG UGCUGCACCAGGACUGGCUGAACGGCAAGGAG UACAAGUGCAAGGUGAGCAACAAGGCCCUGCC UGCGCCCAUCGAGAAGACCAUCAGCAAGGCCA AGGGGCAGCCCAGGGAGCCUGACCAAGAA CCAGGUGAGCCUGACCUGCCUGGUGAAGGGCU UCUACCCCAGCGAUAUUGCUGUGGAGUGGGAG AGCAACGGCCAGCCUGAGAACAACUACAAGAC CACCCCUCCCGUGCUGGACAGCGACGGCAGCU UCUUCCUGUACAGCAAACUGACAGUGGACAAG AGCCGGUGGCAGCAGGGCAACGUGUUCAGCUG CAGCGUGAUGCACGAAGCCCUGCACAACCACU ACACCCAGAAAAGCCUAAGCCUGUCACCCGG AAGCGGAAGAAGCGGUCCUUGAGCCAGGAGG ACGCGCCUCAGACCCCCGGCCUGUGGCUGAA AUCGUGCCCAGCUUCAUCAACAAAGACACCGA GACGAUAAACAUGAUGAGCGAGUUCGUGGCC AACCUGCCCCAGGAGCUGAAGCUCACCCUUGAG CGAGAUGCAGCCCGCUCUGCCACAACUCCAGC AGCACGUGCCCGUCCUUAAGGACAGCAGCCUG CUUUUGGAGUUCAAGAAGCUGAUCCGGA ACCGGCAGAGCGAGGCCGCCGAUAGCUCCCCU AGCGAGCUCAAGUACCUGGGCCUGGACACCCA CAGCAGAAAGAAGCGCCAGCUGUAUAGCGCCC UGGCCAACAAGUGCUGCCAUGUGGGAUGCACA AAAAGAAGCUUGGCCCGGUUCUGC | 5' UTR 1 | 3' UTR 1 | 383 |
| Construct 59 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGAGCCCAAGAGCAGCGACAAG ACCCACACCUCCUCCGUCCCCGCUCCCGA GCUGCUGGGCGGCAGCAGCGUGUUCCUGUUCC CUCCCAAGCCCAAGGACACCCUGUACAUCACC CGGGAGCCCGAGGUGACCUGCGUGGUGGUGGA CGUGAGCCACGAGGACCCUGAGGUGAAGUUCA ACUGGUACGUGGACGGCGUGGAGGUGCACAAC GCCAAGACCAAGCCCGGGAGGAGCAGUACAA CAGCACCUACCGGGUGGUGAGCGUGCUGACCG UGCUGCACCAGGACUGGCUGAACGGCAAGGAG UACAAGUGCAAGGUGAGCAACAAGGCCCUGCC AGCCCUAUCGAGAAGACCAUCAGCAAGGCCA AGGGGCAGCCCAGGGAGCCACAGGUGUACACC CUGCCGCCCAGCCGGGACGAGCUGACCAAGAA CCAGGUGAGCCUGACCUGCCUGGUGAAGGGCU UCUACCCCAGCGACAUCGCUGUGGAGUGGGAG AGCAACGGCCAGCCGGAGAACAACUACAAGAC CACCCCACCCGUGCUGGACAGCGACGGCAGCU UCUUCCUGUACAGCAAGCUCACCGUGGACAAG AGCCGGUGGCAGCAGGGCAACGUGUUCAGCUG CAGCGUGAUGCACGAGGCCCUACACAACCACU ACACCCAGAAAAGCCUGAGCCUAUCCCCCGGC AAGCGGAAGAAGAGAUCGCUGAGCCAGGAGG ACGCCCCCAGACCCCCGGCCCGUAGCCGAG | 5' UTR 1 | 3' UTR 1 | 384 |

TABLE 7-continued

RNA Sequences

| Name | Sequence | 5' UTR | 3' UTR | SEQ ID NO: |
|---|---|---|---|---|
| | AUCGUGCCCAGCUUCAUCAACAAAGACACUGA<br>AACGAUCAACAUGAUGAGCGAGUUCGUGGCCA<br>ACCUGCCCCAGGAGCUGAAGCUCACACUGAGC<br>GAGAUGCAGCCCGCUCUGCCACAGCUCCAGCA<br>GCACGUGCCCGUCCUGAAGGACAGCAGCCUGC<br>UUUUCGAGGAGUUCAAGAAGCUGAUCCGGAA<br>CCGGCAGAGCGAGGCCGCUGACAGCUCACCCA<br>GUGAACUUAAGUACCUGGGCCUGGACACCCAC<br>AGCCGCAAGAAGCGGCAGCUGUACUCCGCCCU<br>GGCCAACAAGUGCUGCCACGUGGGGUGCACCA<br>AACGCAGCCUGGCCCCGGUUCUGC | | | |
| Construct 60 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGAGCCCAAGAGCAGCGACAAG<br>ACCCACACCUCCCCACCUAGCCCAGCCCCCGA<br>GCUGCUGGGCGGCAGCAGCGUGUUCCUGUUCC<br>CACCCAAGCCCAAGGACACCCUGUACAUCACC<br>CGGGAGCCCGAGGUGACCUGCGUGGUGGUGGA<br>CGUGAGCCACGAGGACCCCGAGGUCAAGUUCA<br>ACUGGUACGUGGACGGCGUGGAGGUGCACAAC<br>GCCAAGACCAAGCCCGGGAGGAGCAGUACAA<br>CAGCACCUACCGGGUGGUGAGCGUGCUGACCG<br>UGCUGCACCAGGACUGGCUGAACGGCAAGGAG<br>UACAAGUGCAAGGUGAGCAACAAGGCCCUGCC<br>CGCUCCCAUCGAGAAGACCAUCAGCAAGGCCA<br>AGGGCCAGCCCAGGGAGCCCCAGGUGUACACC<br>CUGCCUCCCAGCCGGGACGAGCUGACCAAGAA<br>CCAGGUGAGCCUGACCUGCCUGGUGAAGGGCU<br>UCUACCCCAGCGACAUCGCUGUGGAGUGGGAG<br>AGCAACGGACAGCCCGAGAACAACUACAAGAC<br>CACCCCUCCCGUGCUGGACAGCGACGGCAGCU<br>UCUUCCUGUACAGCAAACUGACUGUGGACAAG<br>AGCCGGUGGCAGCAGGGCAACGUGUUCAGCUG<br>CAGCGUGAUGCACGAGGCCUUGCACAACCACU<br>ACACCCAGAAAAGCCUGUCCCUGUCCCCCGGC<br>AAGCGGAAGAAGCGGUCACUGUCCCAGGAGGA<br>CGCUCCGACACCCCCGGCCCGGUCGCUGAG<br>UCGUGCCCAGCUUCAUCAAUAAGGAUACCGAG<br>ACAAUUAACAUGAUGAGCGAGUUCGUGGCCA<br>ACCUGCCCCAGGAGCUGAAGCUGACCCUGAGC<br>GAGAUGCAGCCCGCUCUGCCUGCACAGCA<br>GCACGUGCCCGUCCUGAAGGACAGCAGCCUGC<br>UGUUUGAGGAGUUCAAGAAGCUGAUCCGGAA<br>CCGGCAGAGCGAGGCCGCCGAUAGCUCCCCAU<br>CUGACUCAAGUACCUGGGCCUGGACACCCAC<br>AGCAGAAAGAAAGGCAGCUGUACUCCGCCCU<br>GGCCAACAAGUGCUGCCACGUGGGGAUGCACCA<br>AGAGAUCUCUGGCCCGGUUCUGC | 5' UTR 1 | 3' UTR 1 | 385 |
| Construct 61 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGAGCCCAAGAGCAGCGACAAG<br>ACCCACACCUCACCUCCAUCCCCGGCACCCGA<br>GCUGCUGGGCGGCAGCAGCGUGUUCCUGUUCC<br>CUCCCAAGCCCAAGGACACCCUGUACAUCACC<br>CGGGAGCCCGAGGUGACCUGCGUGGUGGUGGA<br>CGUGAGCCACGAGGACCCCGAGGUCAAGUUCA<br>ACUGGUACGUGGACGGCGUGGAGGUGCACAAC<br>GCCAAGACCAAGCCCGGGAGGAGCAGUACAA<br>CAGCACCUACCGGGUGGUGAGCGUGCUGACCG<br>UGCUGCACCAGGACUGGCUGAACGGCAAGGAG<br>UACAAGUGCAAGGUGAGCAACAAGGCCCUGCC<br>UGCGCCUAUCGAGAAGACCAUCAGCAAGGCCA<br>AGGGCCAGCCCAGGGAGCCCCAGGUGUACACC<br>CUGCCUCCCAGCCGGGACGAGCUGACCAAGAA<br>CCAGGUGAGCCUGACCUGCCUGGUGAAGGGCU<br>UCUACCCCAGCGAUAUCGCUGUGGAGUGGGAG<br>AGCAACGGCCAACCCGAGAACAACUACAAGAC<br>CACCCCACCCGUGCUGGACAGCGACGGCAGCU | 5' UTR 1 | 3' UTR 1 | 386 |

| Name | Sequence | 5' UTR | 3' UTR | SEQ ID NO: |
|---|---|---|---|---|
| | UCUUCCUGUACAGCAAACUAACCGUGGACAAG<br>AGCCGGUGGCAGCAGGGCAACGUGUUCAGCUG<br>CAGCGUGAUGCACGAAGCCCUGCACAACCACU<br>ACACCCAGAAAAGCCUCUCCCUGAGCCCCGGC<br>AAGCGGAAGAAGCGGUCCUUGUCACAGGAGG<br>ACGCCCCCCAGACCCCCCGGCCCGUCGCUGAG<br>AUCGUGCCCAGCUUCAUCAACAAAGACACCGA<br>AACAAUUAACAUGAUGAGCGAGUUCGUGGCC<br>AACCUGCCCCAGGAGCUGAAGCUGACACUGAG<br>CGAGAUGCAGCCCGCUCUGCCACAACUGCAGC<br>AGCACGUGCCAGUCCUGAAGGACAGCAGCCUC<br>CUGUUCGAGGAGUUCAAGAAGCUGAUCCGGA<br>ACCGGCAGAGCGAGGCCGCGGACAGCUCACCA<br>AGCGAGCUGAAAUACCUGGGCCUGGACACCCA<br>CAGCCGCAAAAAGAGACAGCUGUACUCCGCCC<br>UGGCCAACAAGUGCUGCCACGUGGGAUGCACC<br>AAAAGAAGCCUGGCCCCGGUUCUGC | | | |
| Construct 62 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGAGCCCAAGAGCAGCGACAAG<br>ACCCACACCAGCCCCCUUCCCCGCCCCCGAG<br>CUGCUGGGCGGCAGCAGCGUGUUCCUGUUCCC<br>GCCCAAGCCCAAGGACACCCUGUACAUCACCC<br>GGGAGCCCGAGGUGACCUGCGUGGUGGUGGAC<br>GUGAGCCACGAGGACCCCGAAGUGAAGUUCAA<br>CUGGUACGUGGACGGCGUGGAGGUGCACAACG<br>CCAAGACCAAGCCCGGGAGGAGCAGUACAAC<br>AGCACCUACCGGGUGGUGAGCGUGCUGACCGU<br>GCUGCACCAGGACUGGCUGAACGGCAAGGAGU<br>ACAAGUGCAAGGUGAGCAACAAGGCCCUGCCC<br>GCUCCCAUCGAGAAGACCAUCAGCAAGGCCAA<br>GGGCCAGCCAAGAGAACCCCAGGUGUACACCC<br>UGCCCCCCUCCCGGGACGAGCUGACCAAGAAC<br>CAGGUGAGCCUGACCUGCCUGGUGAAGGGCUU<br>CUACCCCAGCGACAUUGCCGUGGAGUGGGAGA<br>GCAACGGCCAGCCCGAGAACAACUACAAGACC<br>ACCCCACCCGUGCUGGACAGCGACGGCAGCUU<br>CUUCCUGUACAGCAAGCUGACUGUGGACAAGA<br>GCCGGUGGCAGCAGGGCAACGUGUUCAGCUGC<br>AGCGUGAUGCACGAGGCCUUGCACAACCACUA<br>CACCCAGAAACUGUCCCUUAGCCCCGGCA<br>AGCGGAAGAAGAGGAGCCUUAGCCAGGAGGA<br>CGCCCCACAGACCCCCGGCCCGUGGCUGAAA<br>UCGUGCCCAGCUUCAUCAACAAACACAGAA<br>ACCAUCAACAUGAUGAGCGAGUUCGUGGCCAA<br>CCUGCCCCAGGAGCUGAAGCUCACCCUGAGCG<br>AGAUGCAGCCCGCAUUGCCACAGCUCCAGCAG<br>CACGUGCCUGUGCUGAAGGACAGCAGCUUGCU<br>CUUUGAGGAGUUCAAGAAGCUGAUCCGGAACC<br>GGCAGAGCGAGGCCGCCGACUCCAGCCCCUCU<br>GAGUUAAAGUACCUGGGCCUGGACACCCACAG<br>CAGAAAGAAGCGGCAGCUGUACUCAGCCCUGG<br>CCAACAAGUGCUGCCACGUGGGCUGCACAAAG<br>CGGAGCCUGGCCCGGUUCUGC | 5' UTR 1 | 3' UTR 1 | 387 |
| Construct 63 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGAGCCCAAGAGCAGCGACAAG<br>ACCCACACCAGCCCCCAAGCCCGCCCCCGAG<br>CUGCUGGGCGGCAGCAGCGUGUUCCUGUUCCC<br>GCCCAAGCCAAAGGACACCCUGUACAUCACCC<br>GGGAGCCCGAGGUGACCUGCGUGGUGGUGGAC<br>GUGAGCCACGAGGACCCAGAAGUCAAGUUCAA<br>CUGGUACGUGGACGGCGUGGAGGUGCACAACG<br>CCAAGACCAAGCCCACGGGAGGAGCAGUACAAC<br>AGCACCUACCGGGUGGUGAGCGUGCUGACCGU<br>GCUGCACCAGGACUGGCUGAACGGCAAGGAGU<br>ACAAGUGCAAGGUGAGCAACAAGGCCCUGCCU<br>GCACCCAUCGAGAAGACCAUCAGCAAGGCCAA | 5' UTR 1 | 3' UTR 1 | 388 |

TABLE 7-continued

RNA Sequences

| Name | Sequence | 5' UTR | 3' UTR | SEQ ID NO: |
|---|---|---|---|---|
| | GGGGCAGCCUAGAGAGCCCCAGGUGUACACCC UGCCACCUAGCCGGGACGGAGCUGACCAAGAAC CAGGUGAGCCUGACCUGCCUGGUGAAGGGCUU CUACCCCAGCGACAUCGCUGUGGAGUGGGAGA GCAACGGCCAGCCUGAGAACAACUACAAGACC ACCCCGCCCGUGCUGGACAGCGACGGCAGCUU CUUCCUGUACAGCAAGCUCACGGUAGACAAGA GCCGGUGGCAGCAGGGCAACGUGUUCAGCUGC AGCGUGAUGCACGAAGCUCUGCACAACCACUA CACGCAGAAAAGCUUGAGCCUGUCACCCGGCA AGCGGAAGAAGCGGUCCCUGCUCCAGGAGGAC GCCCCUCAGACCCCCCGGCCAGUAGCGGAGAU CGUGCCCAGCUUCAUCAACAAGGAUACAGAGA CUAUCAACAUGAUGAGCGAGUUCGUGGCCAAC CUGCCCCAGGAGCUGAAGCUGACUCUGAGCGA GAUGCAGCCCGCGCUGCCUCAACUGCAGCAGC ACGUGCCCGUACUGAAGGACAGCAGCUUGCUC UUUGAGGAGUUCAAGAAGCUGAUCCGGAACC GGCAGAGCGAGGCCGCAGAUUCUACCCAGC GAAUUGAAGUACCUGGGCCUGGACACCCACAG CAGAAAGAAGCGACAGUUGUACUCCGCCCUGG CCAACAAGUGCUGCCACGUGGGUUGCACCAAG AGGUCGCUGGCCCGGUUCUGC | | | |
| Construct 64 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGAGCCCAAGAGCAGCGACAAG ACCCACACCUCACCACCAAGCCCUGCACCCGA GCUGCUGGGCGGCAGCAGCGUGUUCCUGUUCC CUCCCAAGCCCAAGGACACCCUGUACAUCACC CGGGAGCCCGAGGUGACCUGCGUGGUGGUGGA CGUGAGCCACGAGGACCCAGAGGUCAAGUUCA ACUGGUACGUGGACGGCGUGGAGGUGCACAAC GCCAAGACCAAACCCCGGGAGGAGCAGUACAA CAGCACCUACCGGGUGGUGAGCGUGCUGACCG UGCUGCACCAGGACUGGCUGAACGGCAAGGAG UACAAGUGCAAGGUGAGCAACAAGGCCCUGCC GGCCCUAUCGAGAAGACCAUCAGCAAGGCCA AGGGCCAGCCAAGGGAACCCCAGGUGUACACC CUGCCCACCAGCCGGGACGAGCUGACCAAGAA CCAGGUGAGCCUGACCUGCCUGGUGAAGGGCU UCUACCCCAGCGACAUCGCAGUGGAGUGGGAG AGCAACGGCCAGCCCGAGAACAACUACAAGAC CACCCCACCCGUGCUGGACAGCGACGGCAGCU UCUUCCUGUACAGCAAGCUGACUGUCGACAAG AGCCGGUGGCAGCAGGGCAACGUGUUCAGCUG CAGCGUGAUGCACGAGGCCUUGCACAACCACU ACACCCAGAAAAGCCUCUCUCUUUCUCCCGGC AAGCGGAAGAAGAGGAGCCUGUCCCAGGAGG ACGCCCCCCAAACUCCCCGGCCCGUGCCUGAG AUCGUGCCCAGCUUCAUCAAUAAAGACACGGA GACAAUCAACAUGAUGAGCGAGUUCGUGGGCA ACCUGCCCCAGGAGCUGAAGCUGACACUGAGC GAGAUGCAGCCCGCACUUCCCAGCUCCAGCA GCACGUGCCCGUCCUGAAGGACAGCAGCUUAC UCUUCGAGGAGUUCAAGAAGCUGAUCCGGAAC CGGCAGAGCGAGGCCGCAGAUUCUAGCCCCUC CGAACUCAAAUACCUGGGCCUGGACACCCACA GCAGAAAGAAAAGACAGCUGUAUUCAGCCCUG GCCAACAAGUGCUGCCACGUGGGCUGCACAAA GCGGAGCCUCGCCCGGUUCUGC | 5' UTR 1 | 3' UTR 1 | 389 |
| Construct 65 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGAGCCCAAGAGCAGCGACAAG ACCCACACCUCCCCUCCCAGUCCUGCCCCGA GCUGCUGGGCGGCAGCAGCGUGUUCCUGUUCC CGCCCAAGCCCAAGGACACCCUGUACAUCACC CGGGAGCCCGAGGUGACCUGCGUGGUGGUGGA CGUGAGCCACGAGGACCCUGAGGUGAAGUUCA | 5' UTR 1 | 3' UTR 1 | 390 |

TABLE 7-continued

RNA Sequences

| Name | Sequence | 5' UTR | 3' UTR | SEQ ID NO: |
|---|---|---|---|---|
| | ACUGGUACGUGGACGGCGUGGAGGUGCACAAC GCCAAGACCAAGCCCCGGGAGGAGCAGUACAA CAGCACCUACCGGGUGGUGAGCGUGCUGACCG UGCUGCACCAGGACUGGCUGAACGGCAAGGAG UACAAGUGCAAGGUGAGCAACAAGGCCCUGCC CGCCCCAAUCGAGAAGACCAUCAGCAAGGCCA AGGGCCAGCCUAGGGAGCCGCAGGUGUACACC CUGCCACCCUCUCGGGACGAGCUGACCAAGAA CCAGGUGAGCCUGACCUGCCUGGUGAAGGGCU UCUACCCCAGCGAUAUCGCCGUCGAGUGGGAG AGCAACGGCCAGCCCGAGAACAACUACAAGAC CACCCCUCCCGUGCUGGACAGCGACGGCAGCU UCUUCCUGUACAGCAAGCUCACCGUGGACAAG AGCCGGUGGCAGCAGGGCAACGUGUUCAGCUG CAGCGUGAUGCACGAAGCUCUGCACAACCACU ACACCCAGAAAAGCUUGAGCCUCAGUCCCGGC AAGCGGAAGAAGCGAUCCUUGAGCCAGGAGG ACGCUCCUCAGACCCCCCGGCCUGUGGCGGAG AUCGUGCCCAGCUUCAUCAACAAAGACACUGA AACCAUUAACAUGAUGAGCGAGUUCGUGGCU AACUUGCCCCAGGAGCUGAAGCUGACUCUGAG CGAGAUGCAGCCCGCUCUCCCCGCAGCUUCAGC AGCACGUGCCCGUGUUGAAGGACAGCAGCCUC CUCUUCGAGGAGUUCAAGAAGCUGAUCCGGAA CCGGCAGAGCGAGGCCGCUGAUUCUUCCCCUA GCGAACUGAAAUACCUGGGCCUGGACACCCAC AGCAGAAAGAAGCGACAGCUGUACUCUGCCCU GGCCAACAAGUGCUGCCACGUGGGCUGCACAA AGAGGAGCCUGGCCCGGUUCUGC | | | |
| Construct 66 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGAGCCCAAGAGCAGCGACAAG ACCCACACCUCACCACCCCGCCUCCCGAG CUGCUGGGCGGCAGCAGCGUGUUCCUGUUCCC UCCCAAGCCCAAGGACACCCUGUACAUCACCC GGGAGCCCGAGGUGACCUGCGUGGUGGUGGAC GUGAGCCACGAGGACCCAGAGGUCAAGUUCAA CUGGUACGUGGACGGCGUGGAGGUGCACAACG CCAAGACCAAGCCCCGGGAGGAGCAGUACAAC AGCACCUACCGGGUGGUGAGCGUGCUGACCGU GCUGCACCAGGACUGGCUGAACGGCAAGGAGU ACAAGUGCAAGGUGAGCAACAAGGCCCUGCCU GCUCCUAUCGAGAAGACCAUCAGCAAGGCCAA GGGCCAGCCUCGGGAACCCCAGGUGUACACCC UGCCCCCUAGCCGGGACGAGCUGACCAAGAAC CAGGUGAGCCUGACCUGCCUGGUGAAGGGCUU CUACCCCAGCGAUAUUGCCGUGGAGUGGGAGA GCAACGGGCAGCCCGAGAACAACUACAAGACC ACCCCGCCCGUGCUGGACAGCGACGGCAGCUU CUUCCUGUACAGCAAGCUUACCGUCGACAAGA GCCGGUGGCAGCAGGGCAACGUGUUCAGCUGC AGCGUGAUGCACGAAGCCUGCACAACCACUA CACCCAGAAAAGCCUCUCUCUGUCUCCCGGCA AGCGGAAGAAGCGCAGUCUCUCAGGAGGAC GCUCCUCAGACCCCCGGCCCGUCGCCGAAAU CGUGCCCAGCUUCAUCAACAAAGACACUGAAA CCAUAAACAUGAUGAGCGAGUUCGUGGCCAAC CUGCCCCAGGAGCUGAAGUUGACUCUGAGCGA GAUGCAGCCCGCCCUGCCACAGCUCCAGCAGC ACGUGCCCGUCCUGAAGGACAGCAGCCUGUUG UUCGAGGAGUUCAAGAAGCUGAUCCGGAACCG GCAGAGCGAGGCCGCCGAUUCCAGCCCCUCUG AGCUCAAGUACCUGGGCCUGGACACCCACAGC CGGAAGAAAAGGCAGUUAUACAGCGCCCUGGC CAACAAGUGCUGCCACGUGGGAUGUACCAAGA GGAGUCUGGCCCGGUUCUGC | 5' UTR 1 | 3' UTR 1 | 391 |
| Construct 67 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA | 5' UTR 1 | 3' UTR 1 | 392 |

TABLE 7-continued

RNA Sequences

| Name | Sequence | 5' UTR | 3' UTR | SEQ ID NO: |
|---|---|---|---|---|
| | GCACCUGGAGCGAGCCCAAGAGCAGCGACAAG ACCCACACCAGUCCCCCCUCUCCCGCACCCGA GCUGCUGGGCGGCAGCAGCGUGUUCCUGUUCC CUCCCAAGCCCAAGGACACCCUGUACAUCACC CGGGAGCCCGAGGUGACCUGCGUGGUGGUGA CGUGAGCCACGAGGACCCCGUGGAGGUGCACAA ACUGGUACGUGGACGGCGUGGAGGUGCACAAC GCCAAGACCAAGCCCCGGGAGGAGCAGUACAA CAGCACCUACCGGGUGGUGAGCGUGCUGACCG UGCUGCACCAGGACUGGCUGAACGGCAAGGAG UACAAGUGCAAGGUGAGCAACAAGGCCCUGCC GGCGCCAAUCGAGAAGACCAUCAGCAAGGCCA AGGGUCAGCCCAGGGAGCCCCAGGUGUACACC CUGCCUCCCUCUCGGGACGAGCUGACCAAGAA CCAGGUGAGCCUGACCUGCCUGGUGAAGGGCU UCUACCCCAGCGACAUCGCUGUGGAGUGGGAG AGCAACGGCCAGCCCGAGAACAACUACAAGAC CACCCCUCCCGUGCUGGACAGCGACGGCAGCU UCUUCCUGUACAGCAAGCUGACAGUGGACAAG AGCCGGUGGCAGCAGGGCAACGUGUUCAGCUG CAGCGUGAUGCACGAGGCCUUGCACAACCACU ACACCCAGAAAAGCCUGAGCCUCUCCCCCGGC AAGCGGAAGAAGAGGAGCCUCAGCCAGGAGG ACGCUCCCCAGACCCCCGGCCAGUGGCCGAA AUCGUGCCCAGCUUCAUCAACAAGGAUACAGA GACAAUUAACAUGAUGAGCGAGUUCGUGGCC AACCUGCCCCAGGAGCUGAAGGAGGGGUCA CGAGAUGCAGCCCGCCCUGCCACAGUUGCAGC AGCACGUGCCCGUACUCAAGGACAGCAGCCUC CUUUUCGAGGAGUUCAAGAAGCUGAUCCGGA ACCGGCAGAGCGAGGCCGCCGACAGUAGCCCA AGCGAACUCAAGUACCUGGGCCUGGACACCCA CAGCAGGAAAAAGAGACAGCUGUAUAGCGCCC UGGCCAACAAGUGCUGCCACGUGGGCUGUACC AAGCGGAGCUUGGCCCGGUUCUGC | | | |
| Construct 68 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGGAGGUGGUGGCUCAGGCGGC GGGGGAUCCGGCGGUGGUGGUAGCGGCGGAG GCGGGUCUGGUGGCGGCGGGUUCAGGGGGAGG GGGCAGUGGGGGAGGAGGCUCUUUCCAGAGC UCCUCCUCCAAGGCCCCACCCCCUAGCCUGCC CAGCCCCAGCCGGCUGCCCGGCCCCAGCGACA CCCCCAUCCUGCCCCAAGGAGGGGUGGCUCC GGGGACGGUGGACAGGGGGGCGGCGGAUCGG UGGCGGGGGUUCUGGGGGGGCGGAUCUGG CGGAGGAGGUCGGGGGGGGUGGGGAUCACAG CUGUACAGCGCCCUGGCCAACAAGUGCUGCCA CGUGGGCUGCACCAAGCGGAGCCUGGCCCGGU UCUGC | 5' UTR 1 | 3' UTR 1 | 393 |
| Construct 69 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGGCGGCGGGGGUCAGGGGA GGAGGGUCCGGGGAGGCGGGAGCGGUGGAG GCGGCUCCCGUGGUGGCGGCGGUGGCGGU GGCAGUGGGGGAGGGGGAUCCUUCCAGAGCUC AUCCUCCAAGGCUCCUCCCCCGAGCCUGCCCA GCCCCAGCCGGCUGCCCGGCCCCAGCGACACC CCCAUCCUGCCCCAGGCGGCGGCGUCUGGA CGGGGUGGUAGUGGCGGAGGAGGAUCUGGA GGGCGGGUCAGGAGGGGUGGAAGCGGGG GGGUGGCUCUGGUGGCGGGGCUCUCAGCUG UACAGCGCCCUGGCCAACAAGUGCUGCCACGU GGGCUGCACCAAGCGGAGCCUGGCCCGGUUCU GC | 5' UTR 1 | 3' UTR 1 | 394 |
| Construct 70 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGGAGGGGGUGGAUCUGGGGG GGGCGGCAGCGGUGGGGGCGGGUCCGGCGGAG GUGGAAGUGGCGGGGGGGGUUCAGGAGGGGG AGGCUCUGGGAGGCGGAGGAAGUUUCCAGAGC UCCUCCUCAAAGGCGCCUCCCCCAAGCCUGCC CAGCCCCAGCCGGCUGCCCGGCCCCAGCGACA CCCCCAUCCUGCCCAAGGUGGCGGUGGUAGC GGGGGUGGUGGGUCAGGCGGCGGCGGAUCGG GUGGCGGAGGUCUGUGGUGGAGGUGGGACGA CGGGGGCGGUAGCGGCGGUGGCGGCUCCCAGC UGUACAGCGCCCUGGCCAACAAGUGCUGCCAC GUGGGCUGCACCAAGCGGAGCCUGGCCCGGUU CUGC | 5' UTR 1 | 3' UTR 1 | 395 |
| Construct 71 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGUGGCGGCGGAUCUGGCGGU GGGGGGUCGGGUGGGGGAGGUUCCGGGGGAG GCGGUUCAGGGGGCGGGGGCUCAGGCGUGG UGGAAGUGGGGGCGGCGGCAGUUUCCAGAGC UCCAGCUCCAAGGCCCCGCCUCCCAGCCUGCC CAGCCCCAGCCGGCUGCCCGGCCCCAGCGACA CCCCCAUCCUGCCCCAGGGAGGGUGGAGGAUCA GGAGGUGGCGGUAGCGGCGGGGGGGCAGCGG AGGCGGGGAUCUGGUGGUGGGGGGGUUCUCAG CUGUACAGCGCCCUGGCCAACAAGUGCUGCCA CGUGGGCUGCACCAAGCGGAGCCUGGCCCGGU UCUGC | 5' UTR 1 | 3' UTR 1 | 396 |
| Construct 72 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGGCGGCGGUGGCAGUGGGGGC GGAGGCGUCUGGUGGUGGGGCUCUCAGGCGGUGG GAGGAAGUGGAGGGGGCGGCUCUGGAGGUGG AGGCUCAGGUGGGGUGGGAGCUUCCAGAGC UCUAGCAGCAAGGCGCCACCCCCAAGCCUGCC CAGCCCCAGCCGGCUGCCCGGCCCCAGCGACA CCCCCAUCCUGCCCCAGGCGGCGGAGGUUCU GGGGGAGGGGGUUCCGGCGGGGGGGCAGCG GAGGGGGGGUAGCGGGGGUGGCGGGAGCGG AGGAGGGGAUCUGGUGGUGGCGAGGAUCCCAGC UGUACAGCGCCCUGGCCAACAAGUGCUGCCAC GUGGGCUGCACCAAGCGGAGCCUGGCCCGGUU CUGC | 5' UTR 1 | 3' UTR 1 | 397 |
| Construct 73 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA GCACCUGGAGCGGAGGGGGGGUCAGGGGGA AGGGGCUCCGGCGGGGAGGGGCUCAGGAGGA GGCGGUUCAGGUGGGGCGGCUCUGGUGGAG GCGGAUCCGGUGGCGGGGGAGCUUCCAGAGC AGCUCGUCCAAGGCCUCCCCUCCCCCAAGCCUGCC CAGCCCCAGCCGGCUGCCCGGCCCCAGCGACA CCCCCAUCCUGCCCCAGGUGGGGAGGAAGC GGAGGUGGUGGCUCCGGGGGCGGUGGCAGUG GCGGAGGGGGCGGGGGAGGGGUCGGUGGGAG UGGAGGGUGGAAGCGGGGGGUGGUGAUCCCAG CUGUACAGCGCCCUGGCCAACAAGUGCUGCCA CGUGGGCUGCACCAAGCGGAGCCUGGCCCGGU UCUGC | 5' UTR 1 | 3' UTR 1 | 398 |
| Construct 74 | AUGGGCGUGAAGGUGCUGUUCGCCCUGAUCUG CAUCGCCGUGGCCGAGGCCGACAGCUGGAUGG AGGAGGUGAUCAAGCUGUGCGGCCGGGAGCU GGUGCGGGCCCAGAUCGCCAUCUGCGGCAUGA | 5' UTR 1 | 3' UTR 1 | 399 |

TABLE 7-continued

RNA Sequences

| Name | Sequence | 5' UTR | 3' UTR | SEQ ID NO: |
|---|---|---|---|---|
| | GCACCUGGAGCGGGGUGGUGGAUCAGGUGG<br>AGGCGGCAGUGGCGGGGGCGGUUCUGGGGGA<br>GGAGGGUCGGGAGGGGGGGAUCUGGUGGUG<br>GCGGAAGUGGCGGCGGUGGAUCCUUCCAGAGC<br>AGUAGCUCUAAGGCCCCACCGCCCAGCCUGCC<br>CAGCCCCAGCCGGCUGCCCGGCCCCAGCGACA<br>CCCCCAUCCUGCCCCAGGGUGGGGGUGGCUCC<br>GGCGGCGGAGGCUCUGGGGGCGGCGGGAGCGG<br>AGGGGGCGGGUCAGGCGGGGGGGGCUCAGGG<br>GGAGGUGGGUCCGGUGGAGGUGGAAGUCAGC<br>UGUACAGCGCCCUGGCCAACAAGUGCUGCCAC<br>GUGGGCUGCACCAAGCGGAGCCUGGCCCGGUU<br>CUGC | | | |
| Construct 75 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGGCGGGAGGCGGAAGCGGCGGG<br>GGUGGGUCCGGGGGUGGCGGGUCAGGGGGCG<br>GAGGGGUCCGGCGGCGGGGGAAGCGGUGGCGG<br>UGGCUCCGGAGGAGGAGGCUCUUUCCAGAGCU<br>CCUCAUCUAAGGCCCCGCCCAGCCUGCCC<br>AGCCCCAGCCGGCUGCCCGGCCCCAGCGACAC<br>CCCCAUCCUGCCCCAGGGCGGUGGAGGCAGUG<br>GUGGGGAGGGAGUGGAGGCGGGGGGGAGUGG<br>GGGGGGGUUCGGGUGGUGGAGGUAGCGGG<br>GGCGGCGGAUCUGGUGGCGGAGGAAGCCAGCU<br>GUACAGCGCCCUGGCCAACAAGUGCUGCCACG<br>UGGGCUGCACCAAGCGGAGCCUGGCCCGGUUC<br>UGC | 5' UTR 1 | 3' UTR 1 | 400 |
| Construct 76 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGGGGGAGGUGGGUCAGGUGG<br>CGGGGGAUCCGGCGGAGGGGGUUCAGGAGGC<br>GGCGGGAGCGGAGGUGGUGGUUCGGGUGGAG<br>GGGGGAGCGGUGGCGGAGGAAGCGGUUCCAGAG<br>CUCCUCCUCUAAGGCCCCGCCCCCUAGCCUGC<br>CCAGCCCCAGCCGGCUGCCCGGCCCCAGCGAC<br>ACCCCCAUCCUGCCCCAGGGGGGCGGUGGAAG<br>CGGCGGGGGCGGAUCUGGUGGCGGGGGGCUCU<br>GGUGGGGAGGGAGUGGGGGGGGAGGCUCAG<br>GGGGGUGGUGGCUCGGGGGCGGCGGCUCACAG<br>CUGUACAGCGCCCUGGCCAACAAGUGCUGCCA<br>CGUGGGCUGCACCAAGCGGAGCCUGGCCCGGU<br>UCUGC | 5' UTR 1 | 3' UTR 1 | 401 |
| Construct 77 | AUGGGCGUGAAGGUGCUGUUCGCCCUGAUCUG<br>CAUCGCCGUGGCCGAGGCCGACAGCUGGAUGG<br>AGGAGGUGAUCAAGCUGUGCGGCCGGGAGCU<br>GGUGCGGGCCCAGAUCGCCAUCUGCGGCAUGA<br>GCACCUGGAGCGGCGGAGGCGGAAGCGGCGGG<br>GGGGCAGUGGUGGAGGUGCGGUUCUGGUGGCG<br>GGGGAUCUGGUGGCGGGUCAGGCGGUGG<br>GGGCAGCGGAGGAGGGGGCUCUUUCCAGAGCU<br>CCUCAUCUAAGGCUCCUCCCCAAGCCUGCCC<br>AGCCCCAGCCGGCUGCCCGGCCCCAGCGACAC<br>CCCCAUCCUGCCCAAGGGGGGGAGGGGAGUG<br>GGGGCGGCGGCUCUGGGGGUGGAGGCUCAGG<br>GGGCGGAGGAAGCGGAGGGGGUGGUAGCGGG<br>GGCGGGGGUAGUGGGGGGGGUGGCUCCCAGC<br>UGUACAGCGCCCUGGCCAACAAGUGCUGCCAC<br>GUGGGCUGCACCAAGCGGAGCCUGGCCCGGUU<br>CUGC | 5' UTR 1 | 3' UTR 1 | 402 |
| Construct 78 | AUGGGCGUGAAAGUGCUGUUUGCGCUGAUUU<br>GCAUUGCGGUGGCGGAAGCGGACUCAUGGAU<br>GGAGGAAGUUAUUAAAUUAUGCGGCCGCGAA<br>UUAGUUCGCGCGCAGAUUGCCAUUUGCGGCAU<br>GGAGCCCAAGAGCAGCGACAAGACCCACACCA<br>GCCCCCCCAGCCCCGCCCCCGAGCUGCUGGGC | 5' UTR 1 | 3' UTR 1 | 403 |
| | GGCAGCAGCGUGUUCCUGUUCCCCCCCAAGCC<br>CAAGGACACCCUCUACAUCACCAGGGAGCCCG<br>AGGUGACCUGCGUGGUGGUGGACGUGAGCCAC<br>GAGGACCCCGAGGUGAAGUUCAACUGGUACGU<br>GGACGGCGUGGAGGUGCACAACGCCAAGACCA<br>AGCCCAGGGAGGAGCAGUACAACAGCACCUAC<br>AGGGUGGUGAGCGUGCUGACCGUGCUGCACCA<br>GGACUGGCUGAACGGCAAGGAGUACAAGUGC<br>AAGGUGAGCAACAAGGCCCUGCCCGCCCCCAU<br>CGAGAAGACCAUCAGCAAGGCCAAGGGCCAGC<br>CCAGGGAGCCCCAGGUGUACACCCUGCCCCCC<br>AGCAGGGACGAGCUGACCAAGAACCAGGUGAG<br>CCUGACCUGCCUGGUGAAGGGCUUCUACCCCA<br>GCGACAUCGCCGUGGAGUGGGAGAGCAACGGC<br>CAGCCCGAGAACAACUACAAGACAACCCCCCC<br>CGUGCUGGACAGCGACGGCAGCUUCUUCCUGU<br>ACAGCAAGCUGACCGUGGACAAGAGCAGGUGG<br>CAGCAGGGCAACGUGUUCAGCUGCAGCGUGAU<br>GCACGAGGCCCUGCACAACCACUACACCCAGA<br>AGAGCCUGAGCCUGAGCCCCGGCAAGAGGAAG<br>AGCACCUGGAGCAAAAGGUCUCUGAGCCAGGA<br>AGAUGCUCCUCAGACACCUAGACCAGUGGCAG<br>AAAUUGCCAUCAAAUCCAAGUAAGAUACA<br>GAAACCAUAAAUAUGAUGUCAGAAUUUGUUG<br>CUAAUUUGCCACAGGAGCUGAAGUUAACCCUG<br>UCUGAGAUGCAGCCAGCAUUACCACAGCUACA<br>ACAACAUGUACCUGUAUUAAAAAGAUUCCAGUC<br>UUCUCUUUGAAGAAUUUAAGAAACUUAUUCG<br>CAAUAGACAAAGUGAAGCCGCAGACAGCAGUC<br>CUUCAGAAUUAAAAUACUUAGGCUUGGAUAC<br>UCAUUCUCGAAAAAAGAGACAACUCUACAGUG<br>CAUUGGCUAAAUAAAAUGUUGCAUGUUGGUU<br>UACCAAAAGAUCUCUUGCUAGAUUUUGC | | | |
| Construct 79 | AUGCCCAGACUGUUCUUCUUCCACCUGCUGGG<br>CGUGUGCCUGUUACUUAACCAGUUCAGCAGC<br>CCGUGGCCGACAGCUGGAUGGAGGAGGUGAUC<br>AAGCUGUGCGGCAGAGAGCUGGUGAGAGCCCA<br>GAUCGCCAUCUGCGGCAUGCUACCUGGAGCG<br>AGCCCAAGAGCAGCGACAAGACCCACACCAGC<br>CCCCCCAGCCCCGCCCCCGAGCUGCUGGGCGG<br>CAGCAGCGUGUUCCUGUUCCCCCCCAAGCCCA<br>AGGACACCCUGUACAUCACCAGAGAGCCCGAG<br>GUGACCUGCGUGGUGGUGGACGUGAGCCACGA<br>GGACCCCGAGGUGAAGUUCAACUGGUACGUGG<br>ACGGCGUGGAGGUGCACAACGCCAAGACCAAG<br>CCCAGAGAGGAGCAGUACAACAGCACCUACAG<br>AGUGGUGAGCGUGCUGACCGUGCUGCACCAGG<br>ACUGGCUGAACGGGAAGGAGUACAAGUGCAA<br>GGUGAGCAACAAGGCCCUGCCCGCCCCCAUCG<br>AGAAGACCAUCAGCAAGGCCAAGGGCCAGCCC<br>AGAGAGCCCCAGGUGUACACCCUGCCCCCCAG<br>CCGAGACGAACUGACCAAGAAUCAGGUGAGCC<br>UGACCUGCCUGGUGAAGGGCUUCUACCCCAGC<br>GACAUCGCCGUGGAGUGGGAAAGCAACGGCCA<br>GCCCGAGAACAACUACAAGACCACCCCCCCCG<br>UGCUGGACAGCGACGGCAGCUUCUUCCUGUAU<br>AGCAAGCUGACCGUGGACAAGUCAAGAUGGCA<br>GCAGGGCAACGUGUUCAGCUGCAGCGUGAUGC<br>ACGAGGCCCUGCACAACCACUACACCCAGAAG<br>AGCCUGAGCCAGGAGGACGCCCCCCAGA<br>CACCUAGACCCGUGGCCGAGAUCGUGCCCAGC<br>UUUAUCAACAAGGACACCGAGACCAUCAACAU<br>GAUGUCCGAGUUCGUGGCCAACCUGCCCCCAG<br>AGCUGAAGCUGACCCUGAGCGAGAUGCCAGCCC<br>GCCCUGCCCCAGCUGCAGCAGCACGUGCCAGU<br>GCUGAAGGACAGCAGCCUGCUGUUCGAGGAGU<br>UCAAGAAGCUGAUCAGAAACAGACAGAAGCGA<br>GGCGCCGACAGCAGCCCCAGCGAGCUGAAGUA<br>CCUGGGCCUGGACACCCACAGCAGAAAGAAGA<br>AGCAACUGUACAGCGCCCUGGCCAAUAAGUG<br>CUGCCACGUGGGCUGCACCAAGAGAAGCCUGG<br>CCAGAUUCUGC | 5' UTR 1 | 3' UTR 2 | 404 |

TABLE 7-continued

RNA Sequences

| Name | Sequence | 5' UTR | 3' UTR | SEQ ID NO: |
|---|---|---|---|---|
| Construct 80 | AUGCCUAGGUUGUUUUUCUUUCACUUACUAG GAGUAUGUUUACUCCUGAACUCAAUUUUCUAG GGCUGUCGCAGAUAGUUGGAUGGAGGAGGUA AUCAAAUUAUGUGGAAGAGAGUUAGUUCGUG CUCAAAUAGCUAUUUGGUGGUAUGUCAACUUG GAGCGGAGGGGGCGGCUCGGGCGGAGGGGGA AGCGGAGGGGGUGGCUCAGGAGGGGGCGGUU CUGGUGGCGGCGGAUCAGGUGGUGGAGGAUC AGGAGGCGGGGGCAGCUUUCAGUCGUCGUCAU CCAAAGCGCUCCACCCUCACUGCCCUCCCCC UCCAGAUUACCUGGGCCCUCCGAUACCCCAU UUUGCCACAAGGGGUGGAGGAUCCGGGGGG GGAGGCAGUGGUGGUGGUGGUAGCGGUGGUG GGGGCGGGGAGGCGGAGGUGGUGGUGG AGGAUCCGGGGGGGCGGAUCGCAGCUCUAUU CCGCUCUUGCCAAUAAAUGUUGCCACUCGGU UGUACAAAACGGUCCCUGGCCAGAUUCUGC | 5' UTR 1 | 3' UTR 2 | 405 |
| Construct 81 | AUGCCCAGACUGUUCUUCUUUCCACCUGCUGGG CGUGUGCCUGUUACUUAACCAGUUCAGCAGAG CCGUGGCCGACAGCUGGAUGGAGGAGGUGAUC AAGCUGUGCGGACAGAGCUGGUGGUGAGAGCCCA GAUCGCCAUCUGCGGCAUGUCUACCUGGAGCG AGCCCAAGAGCAGCGACAAGACCCACACCAGC CCCCCCAGCCCCGCCCCCGAGCUGCUGGGCGG CAGCAGCGUGUUCCUGUUCCCCCCCAAGCCCA AGGACACCCUGUACAUCACCAGAGAGCCCGAG GUGACCUGCGUGGUGGUGGACGUGAGCCACGA GGACCCCGAGGUGAAGUUCAACUGGUACGUGG ACGGCGUGGAGGUGCACAACGCCAAGACCAAG CCCAGAGAGGAGCAGUACAACAGCACCUACAG AGUGGUGAGCGUGCUGACCGUGCUGCACCAGG ACUGGCUGAACGGGAAGGAGUACAAGUGCAA GGUGAGCAACAAGGCCCUGCCCGCCCCCAUCG AGAAGACCAUCAGCAAGGCCAAGGGCCAGCCC AGAGAGCCCCAGGUGUACACCCUGCCCCCCAG CCGAGACGAACUGACCAAGAAUCAGGUGAGCC UGACCUGCCUGGUGAAGGGCUUCUACCCCAGC GACAUCGCCGUGGAGUGGGAGAGCAACGGCCA GCCCGAGAACAACUACAAGACCACCCCCCCCG UGCUGGACAGCGACGGCAGCUUCUUCCUGUAU AGCAAGCUGACCGUGGACAAGUCAAGAUGGCA GCAGGGCAACGUGUUCAGCUGCAGCGUGAUGC ACGAGGCCCUGCACAACCACUACACCCAGAAG AGCCUGAGCCUGAGCCCCGGCAAGAGAAAGAA GAGAAGCCUGAGCCAGGAGGACGCCCCCAGA CACCUAGACCCGUGGCCGAGAUCGUGCCCAGC UUUUAUCAACAAGGACACCGAGACCAUCAACAU GAUGUCCGAGUUCGUGGCCAACCUGCCCCAGG AGCUGAAGCUGACCCUGAGCGAGAUGCAGCCC GCCCUGCCCCAGCUGCAGCACCGUGCCAGU GCUGAAGGACAGCAGCCUGCUGUUCGAGGAGU UCAAGAAGCUGAUCAGAAACAGACAGAGCGA GGCCGCCGACAGCAGCCCCAGCGAGCUGAAGU ACCUGGGCCUGGACACCCACAGCAGAAAGAAG AGACAACUGUACGCGCCCUGGCCCAAUAAGUG CUGCCACGUGGGCUGCACCAAGAGAAGCCUGG CCAGAUUCUGC | 5' UTR 1 | 3' UTR 1 | 406 |
| Construct 82 | AUGGGCGUGAAGGUGCUGUUCGCACUGAUCU GCAUCGCCGUGGCCGAGGCCGACAGCUGGAUG GAGGAGGUGAUCAAGCUGUGCGGCAGAGAGC UGGUGAGAGCCCAGAUCGCCAUCUGCGGCAUG AGCACCUGGAGCGAGCCCAAGAGCAGCGACAA GACCCACACCAGCCCCCCCAGCCCCGCUCCCGA GCUGCUGGGCGGCAGCAGCGUGUUCCUGUUCC CCCCCAAGCCCAAGGACACCCUGUACAUAACC AGAGAGCCCGAGGUGACCUGCGUGGUGGUGG ACGUGAGCCACGAGGACCCCGAGGUGAAGUUC AACUGGUACGUGGACGGCGUGGAGGUGCACA ACGCCAAGACAAAGCCCAGAGAGGAGCAGUAC AACAGCACCUACAGAGUGGUGAGCGUGCUGAC CGUGCUGCACCAGGACUGGCUGAACGGCAAGG | | | |

AGUAUAAGUGCAAGGUGAGCAACAAGGCCCU GCCCGCCCCCAUCGAGAAGACCAUCAGCAAGG CCAAGGGCCAGCCCAGAGAGCCCCAGGUGUAC ACCCUGCCCCCCAGCAGAGACGAGCUGACCAA GAACCAGGUGAGCCUGACCUGCCUGGUGAAGG GCUUCUACCCCAGCGACAUCGCCGUGGAGUGG GAGAGCAACGGCCAGCCCGAGAACAACUACAA GACCACCCCCCCCGUGCUGGACAGCGACGGCA GCUUCUUCCUGUACAGCAAGCUGACCGUGGAC AAGAGCAGAUGGCAGCAGGGCAACGUGUUCA GCUGCAGCGUGAUGCACGAGGCCCUUACAAC CACUACACCCAGAAGAGCCUAAGCCUGAGCCC CGGCAAGAGAAAGAAGAGAAGUCUGAGCCAG GAGGACGCCCCCAGACCCCCAGACCCGUGGC CGAGAUCGUGCCUUCAUUAACAAGGACA CCGAGACCAUCAACAUGAUGAGCGAGUUCGUG GCCAACCUGCCCCAGGAGCUGAAGCUGACCCU GAGCGAAAUGCAACCCGCCCUGCCCCAGCUGC AACGACGACAGCAGCCUGCUGAAGGACAGCAGC CUGCUGUUCGAGGAGUUCAAAAAGCUGAUCA GAAACAGACAGAGCGAGGCCGCCGACUCCAGC CCCAGCGAGCUGAAGUACCUGGGCCUGGACAC CCACAGCAGAAAGAAGCAGCUGUACAGCG CCCUGGCCAACAAGUGCUGCCACGUGGGCUGC ACCAAGAGAAGCCUGGCCAGAUUCUGC

| Construct 83 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUUAU UAAAUUAUGCGGCCGCGAAUUAGUUCGCGCGC AGAUUGCCAUUUGCGGCAUGAGCACCUGGAGC GAGCCCAAGAGCAGCGACAAGACCCACACCAG CCCCCCAGCCCCGCCCCCGAGCUGCUGGGCG GCAGCAGCGUGUUCCUGUUCCCCCCCAAGCCC AAGGACACCCUGUACAUCACCAGGGAGCCCGA GGUGACCUGCGUGGUGGUGGACGUGAGCCACGA AGGACCCCGAGGUGAAGUUCAACUGGUACGUG GACGGCGUGGAGGUGCACAACGCCAAGACCAA GCCCAGGGAGGAGCAGUACAACAGCACCUACA GGGUGUGAGCGUGCUGACCGUGCUGCACCAGG ACUGGCUGAACGGCAAGGAGUACAAGUGCAA GGUGAGCAACAAGGCCCUGCCCGCCCCCAUC GAGAAGACCAUCAGCAAGGCCAAGGGCCAGCC CAGGGAGCCCCAGGUGUACACCCUGCCCCCCA GCAGGGACGAGCUGACCAAGAACCAGGUGAGC CUGACCUGCCUGGUGAAGGGCUUCUACCCCAG CGACAUCGCCGUGGAGUGGGAGAGCAACGGCC AGCCCGAGAACAACUACAAGACCACCCCCCCC GUGCUGGACAGCGACGGCAGCUUCUUCCUGUA CAGCAAGCUGACCGUGGACAAGAGCAGGUGGC AGCAGGGCAACGUGUUCAGCUGCAGCGUGAUG CACGAGGCCCUGCACAACCACUACACCCAGAA GAGCCUGAGCCUGAGCCCCGGCAAGAGGAAGA AAAGGUCUCUGAGCCAGGAAGAUGCUCCUCAG ACACCUAGACCAGUGGCAGAAAUUGUGCCAUC CUUCAUCAACAAGGAUACAGAAACCAUAAAUA UGAUGCAGAAUUUGUCAAUGGUGCCACA GGAGCUGAAGUUAACCCUGUCUGAGAUGCAGC CAGCAUUACCACAGCUACAACAACAUGUACCU GUAUUAAAAGAUUCCAGUCUUCUCUUUGAAG AAUUUAAAAAACUUAUUUCAGCAAGAUAGCAAAG UGAAGCCGCAGACAGCAGUCCUUCAGAAUUAA AAUACUUAGGCUUGGAUACUCAUUCUCGAAA AAAGAGACAACUCUACAGUGCAUUGGCUAAU AAAGUUGCCAAAUAGGUUGUACAAAAGAU CUCUUGCUAGAUUUUGC | 5' UTR 1 | 3' UTR 2 | 408 |
|---|---|---|---|---|
| Construct 84 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUUAU UAAAUUAUGCGGCCGCGAAUUAGUUCGCGCGC AGAUUGCCAUUUGCGGCAUGAGCACCUGGAGC GAGCCCAAGAGCAGCGACAAGACCCACACCAG CCCCCCAGCCCCGCCCCCGAGCUGCUGGGCG | 5' UTR 1 | 3' UTR 1 | 409 |

TABLE 7-continued

RNA Sequences

| Name | Sequence | 5' UTR | 3' UTR | SEQ ID NO: |
|---|---|---|---|---|
| | GCAGCAGCGUGUUCCUGUUCCCCCCCAAGCCC<br>AAGGACACCCUGUACAUCACCAGGGAGCCCGA<br>GGUGACCUGCGUGGUGGACGUGAGCCACG<br>AGGACCCCGAGGUGAAGUUCAACUGGUACGUG<br>GACGGCGUGGAGGUGCACAACGCCAAGACCAA<br>GCCCAGGGAGGAGCAGUACAACAGCACCUACA<br>GGGUGGUGAGCGUGCUGACCGUGCUGCACCAG<br>GACUGGCUGAACGGCAAGGAGUACAAGUGCA<br>AGGUGAGCAACAAGGCCCUGCCCGCCCCCAUC<br>GAGAAGACCAUCAGCAAGGCCAAGGGCCAGCC<br>CAGGGAGCCCCAGGUGUACACCCUGCCCCCCA<br>GCAGGGACGAGCUGACCAAGAACCAGGUGAGC<br>CUGACCUGCCUGGUGAAGGGCUUCUACCCCAG<br>CGACAUCGCCGUGGAGUGGGAGAGCAACGGCC<br>AGCCCGAGAACAACUACAAGACCACCCCCCCC<br>GUGCUGGACAGCGACGGCAGCUUCUUCCUGUA<br>CAGCAAGCUGACCGUGGACAAGAGCAGGUGGC<br>AGCAGGGCAACGUGUUCAGCUGCAGCGUGAUG<br>CACGAGGCCCUGCACAACCACUACACCCAGA<br>GAGCCUGAGCCUGAGCCCCGGCAAGAGGAAGA<br>AAAGGUCUCUGAGCCAGGAAGAUGCUCCUCAG<br>ACACCUAGACCAGUGGCAGAAAUUGUGCCAUC<br>CUUCAUCAACAAAGAUACAGAAACCAUAAAUA<br>UGAUGUCAGAAUUUGUUGCUAAUUUGCCACA<br>GGAGCUGAAGUUAACCCUGUCUGAGAUGCAGC<br>CAGCAUUACCACAGCUACAACAACAUGUACCU<br>GUAUUAAAAGAUUCCAGUCUUCUCUUUGAAG<br>AAUUUAAGAAACUUAUUCGCAAUAGACAAAG<br>UGAAGCCGCAGACAGCAGUCCUUCAGAAUUAA<br>AAUACUUAGGCUUGGAUACUCAUUCUCGAAA<br>AAAGAGACAACUCUACAGUGCAUUGGCUAAU<br>AAAUGUUGCCAUGUUGGUUGUACCAAAAGAU<br>CUCUUGCUAGAUUUGC | | | |
| Construct 85 | AUGCCUCGCCUGUUUUUUUUCCACCUGCUAGG<br>AGUCUGUUUACUACUGAACCAAUUUUCCAGAG<br>CAGUCGCGGACUCAUGGAUGGAGGAAGUUAU<br>UAAAUUAUGCGGCCGCGAAUUAGUUCGCGCGC<br>AGAUUGCCAUUUGCGGCAUGAGCACCUGGAGC<br>GAGGUGCAGCUGCUGGAGAGCGGCGGCGGCCU<br>GGUGCAGCCCGGCGGCAGCCUGAGGCUGAGCU<br>GCGUGGCCAGCGGCUUCACCUUCAACAGCAGC<br>GCCAUGAGCUGGGUGAGGCAGGCCCCCGGCAA<br>GGGCCUGGAGUGGGUGAGCGCCAUCAGCGGCA<br>GCGGCGACAGGACCUACUACGCCGACAGCGUG<br>AAGGGCAGGUUCACCAUCAGCAGGGACAACAG<br>CAAGAACACCCUGUACCUGCAGAUGAACAGCC<br>UGAGGGCCGAGGACACCGCCGUGUACUACUGC<br>ACCACCGACCCCCCAGGUACCACUACAACGG<br>CCUGGCCGUGAGGGGCCAGGGCACCACCGUGA<br>CCGUGAGCAGCAAAAGGUCUCUGAGCCAGGAA<br>GAUGCUCCUCAGACACCUAGACCAGUGGCAGA<br>AAUUGUGCCAUCCUUCAUCAACAAAGAUACAG<br>AAACCAUAAAUAUGAUGUCAGAAUUUGUUGC<br>UAAUUUGCCACAGGAGCUGAAGUUAACCCUGU<br>CUGAGAUGCAGCCAGCAUUACCACAGCUACAA<br>CAACAUGUACCUGUAUUAAAAGAUUCCAGUCU<br>UCUCUUUGAAGAAUUUAAGAAACUUAUUCGC<br>AAUAGACAAAGUGAAGCCGCAGACAGCAGUCC<br>UUCAGAAUUAAAAUACUUAGGCUUGGAUACU<br>CAUUCUCGAAAAAAGAGACAACUCUACAGUGC<br>AUUGGCUAAUAAAUGUUGCCAUGUUGGUUGU<br>ACCAAAAGAUCUCUUGCUAGAUUUGC | 5' UTR 1 | 3' UTR 2 | 410 |
| Construct 86 | AUGCCUCGCCUGUUUUUUUUCCACCUGCUAGG<br>AGUCUGUUUACUACUGAACCAAUUUUCCAGAG<br>CAGUCGCGGACUCAUGGAUGGAGGAAGUUAU<br>UAAAUUAUGCGGCCGCGAAUUAGUUCGCGCGC<br>AGAUUGCCAUUUGCGGCAUGAGCACCUGGAGC<br>GAGGUGCAGCUGCUGGAGAGCGGCGGCGGCCU<br>GGUGCAGCCCGGCGGCAGCCUGAGGCUGAGCU<br>GCGCCGCCAGCGGCUUCACCUUCAGCAGCUAC<br>GCCAUGAGCUGGGUGAGGCAGGCCCCCGGCAA<br>GGGCCUGGAGUGGGUGAGCGCCAUCAGCGGCA | 5' UTR 1 | 3' UTR 2 | 411 |
| Construct 87 | AUGCCUCGCCUGUUUUUUUUCCACCUGCUAGG<br>AGUCUGUUUACUACUGAACCAAUUUUCCAGAG<br>CAGUCGCGGACUCAUGGAUGGAGGAAGUUAU<br>UAAAUUAUGCGGCCGCGAAUUAGUUCGCGCGC<br>AGAUUGCCAUUUGCGGCAUGAGCACCUGGUCC<br>GGGUCGACCGAUAGCGGUUCCGACACUUCCUC<br>CGGAAACUCCGGGAGGCAACAGCGGCUUCC<br>AGUCGAGCUCCUCAAAGGCCCCACCUCCCUCA<br>CUGCCCUCCCCUUCUCGGCUCCCUGGACCGUC<br>CGAUACUCCGAUCCUGCCGCAAUUCCAGUCCA<br>GCAGCCUCCAAGGCCCCUCCACCGUCACUGCCA<br>UCCCCGUCGAGGUGCCGGACCUCCUCAGACAC<br>GCCAUCCUGCCUCAGGGCAGCACCGACUCGG<br>GAUCCGAUACCUCGUCGGGAACUCCGGCGAC<br>GGGAACUCGGGACAACUCUACAGUGCAUUGGC<br>UAAUAAAUGUUGCCAUGUUGGUUGUACCAAA<br>AGAUCUCUUGCUAGAUUUGC | 5' UTR 1 | 3' UTR 2 | 412 |
| Construct 88 | AUGCCUCGCCUGUUUUUUUUCCACCUGCUAGG<br>AGUCUGUUUACUACUGAACCAAUUUUCCAGAG<br>CAGUCGCGGACUCAUGGAUGGAGGAAGUUAU<br>UAAAUUAUGCGGCCGCGAAUUAGUUCGCGCGC<br>AGAUUGCCAUUUGCGGCAUGAGCACCUGGUCC<br>GGAGGAGGAGGCUUCCAGUCAAGCAGCUC<br>CAAGGCCCCUCCACCAAGCCUCCCUAGCCCGU<br>CCAGGCUUCCGGGACCGUCCGGAUACUCCCAUC<br>CUGCCCCAGUUCCAGUCCUCGUCGUCCAAGGC<br>UCCCCUCCAUCCCUGCCGCAAUUCCAGUCCA<br>UGCCAGGACCGUCCGACACCCCUAUCCUGCCG<br>CAAGGCGGUGGGGUCACAACUCUACAGUGC<br>AUUGGCUAAUAAAUGUUGCCAUGUUGGUUGU<br>ACCAAAAGAUCUCUUGCUAGAUUUGC | 5' UTR 1 | 3' UTR 2 | 413 |
| Construct 89 | AUGCCGAGACUGUUCUUCUUCCACCUCCUCGG<br>CGUGUGCCUCCUCCUCAACCAGUUCUCUCGAG<br>CCGUGGCGGAUAGCGGAUGGAGGAGGUGAU<br>CAAGCUGUGGCCGUGAUGCUGCUCCGGGCCU<br>AGAUCGCCAUCUGCGGCAUGUCCACCUGGUCC<br>GAGCCCAAGUCCUCCGACAAGCCCACACCUC<br>GCCCCCCAGCCCUGCCCCGAGCUCCUGGGCG<br>GCAGCUCCGUCUCGUGUCCCGCCUCAAGCCG<br>AAGGAUACCCUGUACAUCACCAGGGAGCCCGA<br>GGUGACCUGUCGUGGUGGACGUGAGCCACG<br>AGGACCCCGAGGUGAAGUUUAAUUGGUACGUU<br>CGACGGCGUGGAGGUGCACAACGCCAAGACCA<br>AGCCCAGGGAGGAGCAGUACAACUCCACCUAC<br>CGGGUGGUGAGCGUGCUGACAGUCCUGCAUCA<br>GGACUGGCUGAACGGCAAGGAAUACAAGUGC<br>AAGGUGAGCAACAAGGCCCUGCCGCCCCCAU<br>CGAGAAGACCAUCAGCAAGGCCAAGGGCCAAC<br>CCCGGGAACCCCAGGUCUACACCCUGCCUCCC<br>AGCAGGGAUGAGCUGACCAAGAACCAGGUUA<br>GCCUGACCUGCCUGGUCAAGGGCUUCUACCCC<br>UCCGACAUUGCCGUGGAGUGGGAGAGCAACGG | 5' UTR 1 | 3' UTR 1 | 414 |

TABLE 7-continued

RNA Sequences

| Name | Sequence | 5' UTR | 3' UTR | SEQ ID NO: |
|---|---|---|---|---|
| | UCAGCCCGAGAACAACUACAAGACCACCCCUC CCGUGCUCGACAGCGACGUUCCUUCUUCCUG UACAGCAAGCUGACGGUGGACAAGAGCCGCUG GCAGCAGGGCAACGUGUUCAGCUGCUCCGUGA UGCACGAAGCCCUGCACAACCACUACACCCAG AAGUCCCUGAGCCUGUCACCCGGCAAGAGGAA GAAGCGGAGCCUGUCCCAGGAGGAUGCCCCCC AGACCCCUAGACCUGUGGCCGAAAUUGUGCCC UCCUUUAUCAACAAGGACACCGAAACCAUCAA UAUGAUGUCCGAGUUCGUGGCCAACCUGCCCC AGGAGCUGAAACUCACCCUGAGCGAGAUGCAG CCCGCCCUGCCCCAGCUGAACAGCACGUGCC CGUGCUGAAGGACUCAUCUCUGCUGUUCGAGG AAUUCAAGAAGCUGAUCAGGAACAGGCAGAG CGAGGCCGCCGACAGCAGUCCCAGCGAGCUGA AAUACCUGGGCCUGGACACCCACUCCCGCAAG AAGCGGCAGCUGUACAGCGCCCUGGCCAACAA GUGCUGCCACGUAGGCUGCACCAAACGCAGCC UGGCACGGUUCUGC | | | |
| Construct 90 | AUGCCCGUCUCUUCUUCUUCCACCUCCUCGG AGUGUGCCUCCUCCUCAACCAGUUCAGCAGGG CCGUGGCCGACUCCUGGAUGGAGGAAGUGAUC AAGCUCUGCGGCAGGGAGCUCGUGAGGGCCCA AAUCGCCAUCUGCGGCAUGAGCACCUGGUCCG AGCCCAAGAGCUCCGACAAGACUCACACCAGC CCCGCCCAGCCCCGCCCCCGAGCUGCUGGGCGG GAGCAGCGUGUUUCUGUUCCCUCCCAAGCCCA AGGACACCCUGUACAUCACCCGCGAGCCGGAA GUGACCUGCGUGGUGGUGGACGUCUCCCACGA GGACCCCGAGGUGAAAUUCAACUGGUACGUGG ACGGCGUGGAAGUGCACAAUGCGAAGACAAG CCCAGGGAGGAGCAGUACAACAGCACCUACAG GGUAGUCAGCGUGCUGACCGUGCUGCAUCAGG ACUGGCUGAAUGGCAAGGAGUACAAGUGCAA AGUGUCCAAUAAGGCUCUGCCCGCCCCCAUCG AGAAGACCAUCAGCAAAGCCAAGGGACAGCCC AGAGAGCCCCAGGUGUACACCCUGCCCCCGAG CAGGGACGAGCUGACCAAGAACCAGGUCAGCC UGACCUGCCUGGUGAAGGGUUUUACCCCAGC GACAUCGCCGUGGAGUGGGAGAGCAACGGCCA GCCCGAGAACAACUACAAGACGACACCCCGG UGCUGGACAGCGACGGGUCUUUCUUCCUGUAC AGCAAGCUGACCGUGGAUAAAAUCCAGAUGGCA GCAGGGCAACGUCUUCAGCUGCUCCGUGAUGC AUGAGGCCCUGCACAACCACUACACGCAGAAG UCACUGUCCCUGAGCCCCGGCAAGAGGAAGAA GCGGAGCCUGAGCCAGGAGGACGCCCCCCAGA CCCCCCGGCCCGUGCGGAGAUCGUGCCUAGC UUCAUCAACAAGGACACCGAGACUAUCAACAU GAUGAGCGAGUUCGUGGCCAACCUGCCCCAGG AGCUGAAGCUCACCCUGUCCGAAAUGCAGCCG GCCCUCCCGCAGCUGCAGCAGCACGUACCCGU GCUGAAAGAUUCCAGUCUGCUGUUUGAGGAG UUCAAGAAGCUGAUCAGGAAUCGGCAGUCCGA GGCCGCCGACAGCCCGUCCGAGUUGAAGU ACCUGCCCUGGAUACCCAUUCCGGAAGAAG AGGCAACUGUACUCCGCCCUGGCCAACAAGUG CUGUCACGUGGGGUGCACAAAGAAGCCUGG CCCGUUUCUGC | 5'UTR 1 | 3'UTR 1 | 415 |
| Construct 91 | AUGCCCAGGCUGUUCUUCUUCCACCUCCUCGG CGUGUGUCUCCUCCUCAACCAAUUUAGCCGUG CCGUGGCGGACAGCUGGAUGGAGGAGGUGAU CAAGCUGUGUGGACAGGGAGCUGGUCCGUGCG AGAUUGCCAUCUGUGGCAUGUCCACCUGGAGC GAGCCCAAGUCCAGCGACAAGACCCACACCAG CCCGCCCAGCCCUGCCCCGAGCUGCUGGGCG GCAGCAGCGUGUUCUGGUUCCCUCCCAAGCCA AAGGACACACUGUACAUAACCCGGGAGCCCGA GGUGACCUGUGUGGUGGUCGACGUCAGCCAG AGGACCCCGAGGUCAAAUUCAACUGGUACGUG GACGGCGUGGAGGUGCACAACGCCAAGACUAA ACCCCGGGAGGAACAAUACAACUCCACCUACA | 5'UTR 1 | 3'UTR 1 | 416 |
| | GGGUGGUAUCCGUGCUGACCGUCCUGCACCAG GAUUGGCUCAACGGCAAAGAGUAUAAGUGCA AAGUGUCCAACAAGGCCCUGCCCGCCCCCAUC GAGAAGACGAUCAGCAAGGCCAAGGGCCAGCC CCGGGAGCCCCAGGUCUACACGCUGCCCCCCA GCAGAGACGAGCUUACCAAGAACCAGGUUUCC CUGACCUGCCUGGUGAAGGGCUUCUACCCGAG CGACAUUGCCGUGGAGUGGGAGAGCAACGGCC AGCCCGAGAAUAACUACAAGACCACGCCCCCC GUGCUCGACUCCGACGGCAGCUUCUUUCUCUA CUCCAAGCUGACCGUUGACAAGAGCCGCUGGC AGCAGGGAAACGUGUUCAGCUGCAGCGUCAUG CACGAGGCCCUGCACAACCACUACACGCAGAA GUCCCUGAGCCUGUCCCCGGCAAACGUAAGA AGAGGAGCCUGACCCAGGAGGACGCCCCCCAC ACCCCCAGGCCAGUGCCGAGAUCGUCCCCUC CUUCAUAAACAAGGACACCGAAACCAUCAACA UGAUGAGCGAGUUCGUGGCCAACCUGCCCCAG GAGCUGAAGCUGACCCUCAGCGAGAUGCAGCC CGCCCUCCCCAACUCCAGCAGCACGUGCCCG UGCUCAAGGACAGCAGCCUGCUGUUUGAGGAG UUCAAGAAAACUGAUCCGCAACAGACAGAGCGA GGCCGCCGACAGCCCCAGCGAGCUCAAGU ACCUGGGUCUGGACACCCAUAGCAGGAAGAAG AGGCAGCUGUACAGUGCCCUGGCGAACAAGUG CUGCCACGUGGGCUGCACCAAGAGGAGCCUUG CCAGGUUCUGC | | | |
| Construct 92 | AUGCCGAGACUUUUCUUCUUCCACUUGCUCGG CGUGUGCCUCCUCCUUAACCAAUUUAGCAGAG CCGUGGCAGACUCCUGGAUGGAGGAGGUGAUC AAGCUCUGCGGCAGGGAGCUCGUGAGGGCCA GAUCGCCAUUUGCGGUAUGUCCACAUGGAGCG AGCCCAAGAGCUCAGAUAAGACCCACACCAGC CCUCCCAGCCCCGCCCCGAGCUGCUGGGCGG CAGCAGCGUGUUCUCUUCCCGCCCAAACCCA AGGACACCCUGUACAUCACCAGGGAGCCCGAG GUGACCUGCGUGGUCGUCGACGUAUCCCACGA GGACCCCGAGGUGAAGUUCAACUGGUACGUGG ACGGCGUGGAAGUGCACAAUGCCAAGACAAAG CCCCGGGAGGAGCAGUACAACAGCACCUACCG GGUGGUGUCCGUGCUGACAGUCCUGCACCAGG ACUGGCUGAACGGCAAGGAGUACAAGUGCAA GGUCAGCAACAAAGCCCUGCCCGCCCCCAUCG AGAAGACCAUCUCAAAGGCCAAGGGCCAGCCC CGCGAGCCACAGGUGUAUACGCUGCCGCCCAG CAGAGACGAGCUGACCAAGAACCAGGUGAGCC UGACCUGCCUCCAAGGGCCUUCAUCCGC GACAUCGCCGUUGAGUGGGAGAGCAACGGCCA GCCCGAGAACAACUAUAAGACCACUCCACCCG UCCUGGACAGCGAUGGGAGCUUCUUCCUGUAC UCCAAGCUGACCGUCGACAAGUCCCGGUGGCA GCAGGGCAAUGUGUUCAGCUGCUCCGUGAUGC ACGAGGCCUGCAUAACCAUUACACCCAGAAG UCGCUGAGCCUGAGCCCUGGCAAGAGGAAGAA ACGCAGCCUGAGCCAGGAGGAUGCCCCGCAGA CCCCUCGGCCCGGUGGCCGAGAUCGUGCCUUCC UUCAUCAACAAGGACACCGAGACAAUCAACAU GAUGUCCGAGUUCGUAGCCAAUCUGCCCAGG AGCUGAAGCUGACCCUCUCCGAGAUGCAGCCC GCCCUCCCAGCUGCAGCAGCACACGUCCCGGU GCUCAAGGACAGCAGCCUGCUGUUCGAGGAGU UUAAGAAGCUGAUCCGCAACAGGCAGUCCGAG GCCGCCGAUAGCAGCCCCAGCGAGCUGAAGUA CCUGGGCCUCGACACAACAUAGCAGGAAGAAGC GGCAGCUCUACUCCGCCCUCGCAAUAAGUGC UGUCACGUGGGCUGCACCAAGAAGAGCCUGGC CAGAUUUUGC | 5'UTR 1 | 3'UTR 1 | 417 |
| Construct 93 | AUGCCCCGGCUGUUCUUCUUCCACCUCCUCGG CGUGUGCCUCCUCCUCAUCAGUUCUCCAGGG CCGUCGCCGACUCCUGGAUGGAGGAGGUGAUC AAGCUCUGCGGGCGCGAGCUCGUGAGAGCCCA GAUUGCCAUCUGCGGCAUGUCCACCUGGAGCG | 5'UTR 1 | 3'UTR 1 | 418 |

TABLE 7-continued

RNA Sequences

| Name | Sequence | 5' UTR | 3' UTR | SEQ ID NO: |
|---|---|---|---|---|
| | AGCCCAAGAGCAGCGACAAGACCCACACCUCC CCUCCCAGCCCCGCGCCGGAGCUGCUGGGCGG CAGCAGCGUGUUUCUGUUCCCUCCCAAGCCCA AGGACACCCUGUACAUCACUAGGGAGCCCGAG GUGACCUGCGUGGUCGUGGAUGUGAGCCACGA AGAUCCAGAGGUGAAGUUCAAUUGGUACGUC GACGGCGUGGAGGUGCACAAUGCCAAGACCAA GCCCAGGGAGGAGCAGUACAACAGCACCUACA GGGUCGUUUCCGUGCUCACCGUGCUGCACCAG GACUGGCUGAACGGCAAGGAGUACAAGUGCA AGGUCAGCAACAAAGCCCUACCCGCCCCCAUC GAGAAGACAAUCAGCAAAGCCAAGGGCCAGCC CAGGGAGCCCCAGGUGUAUACCCUCCCACCCU CCAGGGACGAACUGACCAAGAAUCAGGUCAGC CUGACCUGCCUUGUCAAGGGCUUUUACCCCAG CGACAUCGCCGUGGAGUGGGAGAGCAACGGCC AACCCGAGAACAAUUACAAGACCACCCCGCCC GUCCUGGACUCCGACGGGUCCUUCUUCCUAUA CAGCAAGCUGACCGUGGACAAGUCCAGAUGGC AGCAAGGGAACGUGUUCUCCUGCUCCGUGAUG CACGAGGCCCUGCACAAUCACUACACGCAGAA GAGUCUGAGCCUGAGCCCCGGGAAGCGGAAGA AGCGAUCCCUGAGCCAGGAGGACGCCCCGCAG ACACCCCGCCCCGUGGCCGAGAUUGUGCCCAG CUUCAUCAACAAGGACACCGAGACGAUCAAUA UGAUGUCCGAGUUCGUGGCCAACCUGCCACAG GAACUGAAGCUGACCCUGAGCGAGAAUGCAGC UGCGCUUCCGCAGCUGCAACAACAUGUCCCCG UGCUGAAGGACAGCAGCCUGCUGUUUGAGGA GUUCAAGAAGCUGAUAAGGAACCGGCAGAGC GAGGCCGCCGACAGCAGCCCCAGCGAACUGAA GUACCUGGGCCUGGACACCCACAGCAGAAAGA AGAGGCAACUGUAUAGCGCACUGGCUAAUAA GUGCUGUCACGUGGGCUGCACCAAACGCAGCC UGGCCAGGUUCUGC | | | |
| Construct 94 | AUGCCCAGACUGUUCUUCUUCCACCUCCUCGG GGUGUGCCUCCUCCUCAACCAGUUCUCCAGGG CCGUGGCCGACAGCUGGAUGGAGGAGGUGAUC AAGCUCUGCGGCAGAGCUCGUCUGCAGGGCCA GAUCGCCAUCUGCGGUAUGACACGUGGAGCG AGCCCAAGAGCUCCGACAAGACCCAUACAAGC CCCCCGAGCCCCGCGCCCGAACUCCUGGGGGG CUCCAGCGUGUUUCUGUUCCCGCCCAAGCCCA AAGACACCCUGUACAUCACCCGGGAGCCUGAG GUGACCUGCGUGGUGGUGGACGUGUCCCACGA AGACCCUGAGGUGAAAUUCAACUGGUACGUG GACGGCGUGGAGGUGCAUAACGCCAAGACCAA ACCGCGUGAGGAGCAAUACAACAGCACCUACC GGGUGGUGUCGGUGCUGACCGUCCUGCACCAG GACUGGCUGAACGGCAAGGAGUACAAGUGUA AGGUGUCCAACAAGGCCUCUCCCGCCCCCAUC GAGAAGACCAUCUCCAAGGCCAAGGGCCAGCC CCGCGAGCCCCAGGUGUACACCCUCCCGCCCA GCCGCGACGAGCUGACCAAGAACCAGGUGUCC CUGACCUGCUUGGUGAAGGGCUUCUACCCCAG CGACAUCGCCGUGGAAUGGGAGUCCAACGGCC AGCGGGAGAACAACUACAAGACCACUCCCCCC GUCCUGGACAGCGACGGCUCCUUCUUCCUGUA CAGCAAGCUGACCGUCGACAAGUCCCGCUGGC AGCAGGGCAACGUGUUCUCCUGCUCCGUGAUG CACGAGGCCCUGCACAACCACUACACUCAGAA GUCUCUGUCCCUUAGCCCCGGCAAGCGGAAGA AGAGGAGCUGAGCCAGGAGGACGCCCCCCAA ACGCCUCGCCCCGUGGCCGAGAUUGUGCCCAG CUUCAUCAACAAGGACACCGAGAAACCAUCAUA UGAUGUCCGAGUUCGUGGCCAACCUGCCCCAG GAGCUGAAGCUGACCCUGUCCGAGAUGCAGCC CGCGGCAGCUGCAACAGCCAUGUCCCGUGCU UGCUGAAGGACAGCAGCCUGCUGUUCGAGGAG UUUAAGAAGCUGAUCAGAAACAGACAAUCCG AGGCAGCCGACUCCUCCCCCAGCGAGCUGAAA UACCUGGGCCUGGACACCCAUUCCCGGAAGAA GCGGCAGCUGUACAGCGCCCUCGCCAACAAGU | | | |
| | GCUGCCACGUGGGCUGCACCAAGAGAAGCCUG GCCAGGUUCUGC | | | |
| Construct 95 | AUGCCCCGCCUGUUCUUCUUCCACCUCCUCGG CGUGUGUCUCCUCCUUAACCAGUUCUCCCCGUG CCGUGGCCGAUAGCUGGAUGGAGGAGGUGAU CAAGCUCUGCGGCCGAGAGCUCGUGAGGGCAC AGAUCGCCAUCUGUGGCAUGUCCACCUGGAGC GAACCCAAGAGCUCCGAUAAGACCCACACCAG CCCCCCUUCUCCCGCCCCGAGCUGCUCGGCG GCAGCUCGGUGUUCUGUUCCCACCCAAACCC AAGGACACCCUCUACAUCACCAGAGAGCCCGA GGUAACCUGUGUGGUCGUGGAUGUGUCCCACG AGGACCCCGAGGUGAAGUUCAACUGGUACGUG GACGGGGUGGAGGUGCACAACGCCAAGACCAA GCCCCGCGAGGAGCAGUACAACAGCACCUACC GCGUGGUGAGCGUGCUGACAGUGCUGCACCAG GAUUGGCUGAACGGCAAGGAGUACAAGUGCA AGGUGAGCAACAAGGCCCUGCCCGCCCCCAUC GAGAAGACCAUCAGCAAGGCCAAAGGGCAGCC CAGAGAACCCAGGUGUACACCCUGCCCCCCA GCCGGGACGAGCUGACCAAGAACCAAGUGAGC CUCACCUGCCUGGUGAAGGGUUCUACCCCAG CGACAUCGCCGUGGAGUGGGAGAGCAACGGCC AGCCCGAGAACAACUACAAGACCACGCCUCCC GUGCUGGACUCCGACGGGAGCUUCUUCCUGUA CAGCAAGCUGACCGUGGACAAGAGCCGCUGGC AACAGGGGAACGUGUUUAGCUGUAGCGUCAU GCACGAGGCCCUGCACAUCACUACACCCAGA AGUCCCUGAGCCUGUCCCCCGGCAAGAGGAAG AAGCGUUCCCUGAGCCAGGAGGACGCCCCCCA GACACCCAGGCCGGCCGCAGAGAUCGUGCCCU CCUUCAUCAACAAGGACACCGAGACAAUCAAC AUGAUGAGCGAGUUCGUGGCCAACCUGCCCCA GGAACUGAAGCUCACCCUGUCCGAGAUGCAGC CCGCCGCUGCCUCUACAGCAGCACGUACCC GUGCUGAAGGACAGCAGCCUGCUGUUCGAGGA GUUCAAGAAGCUGAUAAGGAAUCGCAGUCCG AGGCCGCCGACUCAUCCCCUAGCGAGCUGAAG UACCUCGGACUGGACACCACAGCCGCUAAGAA GAGGCAGCUGUAUUCCGCCCUGGCCAACAAAU GCUGCCAUGUGGGCUGCACCAAGAGAAGCCUG GCCCGGUUCUGC | 5' UTR 1 | 3' UTR 1 | 420 |
| Construct 96 | AUGCCCCGGCUUUUCUUCUUCCACUUACUCGG CGUGUGCCUUUCUCCUUAACCAGUUCAGCCGGG CCGUGGCCGACAGCUGGAUGGAGGAGGUGAUC AAGCUCUGCGGCCGGGAACUCGUGCGGGCCCA GAUCGCCAUCUGCGGCAUGAGCACCUGGAGCG AGCCCAAGAGCAGCGACAAGACCCACACCAGU CCACCGUCCCCUGCCCCGAGUUACUGGGCGG CAGCAGCGUGUUCCUGUUCCCACCAAAGCCCA AGGACACCCUGUACAUCACCCGGGAGCCCGAG GUGACCUGCGUGGUGGUGGACGUGAGCCACGA GGACCCUGAGGUCAAGUUCAACUGGUACGUGG ACGGCGUGGAGGUGCACAACGCCAAGACCAAG CCCCGGGAGGAGCAGUACAACAGCACCUACCG GGUGGUGAGCGUGCUGACCGUGCUGCACCAGG ACUGGCUGAACGGCAAGGAGUACAAGUGCAA GGUGAGCAACAAGGCCCUGCCUGCCCCGAUCG AGAAGACCAUCAGCAAGGCCAAGGGCCAGCCU CGCGAGCCUCAGGUGUACACCCUGCCACCAAG CCGGGACAGCUGACCAAGAACCAGGUGAGCC UGACCUGCCUGGUGAAGGGCUUCUACCCCAGC GACAUCGCCGUGGAGUGGGAGAGCAACGGCCA GCCAGAGAACAACUACAAGACCACACCCCCG UGCUGGACAGCGACGGCAGCUUCUUCCUGUAC AGCAAGCUGACAGUGGACAAGAGCCGGUGGCA GCAGGGCAACGUUCUGCUGCUCCGUGAUGC ACGAGGCCCUACACAACCACUACACCCAGAAG UCCCUGUCUCUGUCACCCGGCAAGCGGAAGAA GAGAUCCCUGAGCCAGGAGGACGCCCCCGAGA CCCCCCGGCCAGUGGCCGAGAUCGUGCCCAGC UUCAUCAACAAGGAUACCGAGACGAUCAACAU | 5' UTR 1 | 3' UTR 1 | 421 |

TABLE 7-continued

RNA Sequences

| Name | Sequence | 5' UTR | 3' UTR | SEQ ID NO: |
|---|---|---|---|---|
| | GAUGAGCGAGUUCGUGGCCAACCUGCCCCAGG AGCUGAAGCUCACACUGAGCGAGAUGCAGCCC GCCCUGCCGCAACUCCAGCAGCACGUGCCAGU GCUGAAGGACAGCAGCCUGCUGUUCGAGGAGU UCAAGAAGCUGAUCCGGAACCGGCAGAGCGAG GCCGCUGACAGCUCUCCUAGCGAACUGAAGUA CCUGGGCCUGGACACCCACAGCAGGAAGAAGC GGCAGCUGUACUCAGCCCUGGCCAACAAGUGC UGCCACGUGGGCUGCACUAAGAGAAGCCUCGC CCGGUUCUGC | | | |
| Construct 97 | AUGCCCAGACUGUUCUUCUUCCACCUCCUCGG CGUGUGCCUCCUCCUCAACCAGUUCAGCCGGG CCGUGGCCGACAGCUGGAUGGAGGAGGUGAUC AAGCUAUGCGGCCGGGAGCUCGUGCGGGCCCA GAUCGCCAUCUGCGGCAUGAGCACCUGGAGCG AGCCCAAGAGCAGCGACAAGACCCACACCUCC CCGCCGUCCCCAGCUCCCGAGCUGUUAGGAGG CAGCAGCGUGUUCCUGUUCCCGCCUAAGCCCA AGGACACCCUGUACAUCACCCGGGAGCCCGAG GUGACCUGCGUGGUGGUGGACGUGAGCCACGA GGACCCGGAGGUGAAGUUCAACUGGUACGUG GACGGCGUGGAGGUGCACAACGCCAAGACCAA GCCCCGGGAGGAGCAGUACAACAGCACCUACC GGGUGGUGAGCGUGCUGACCGUGCUGCACCAG GACUGGCUGAACGGCAAGGAGUACAAGUGCA AGGUGAGCAACAAGGCCCUGCCUGCCACCUAUC GAGAAGACCAUCAGCAAGGCCAAGGGCCAGCC AAGAGAGCCUCAGGUGUACACCCUGCCACCUA GCCGGGACGAGCUGACCAAGAACCAGGUGAGC CUGACCUGCCUGGUGAAGGGCUUCUACCCCAG CGACAUCGCCGUGGAGUGGGAGAGCAACGGCC AGCCUGAGAACAACUACAAGACCACUCCACCC GUGCUGGACAGCGACGGCAGCUUCUUCCUGUA CAGCAAGCUCACCGUGGACAAGAGCCGGUGGC AGCAGGGCAACGUGUUCAGCUGCAGCGUGAUG CACGAGGCUCUGCACAACCACUACACCCAGAA GAGUCUGUCGCUGAGCCCCGGCAAGCGGAAGA AGAGAAGCCUGAGCCAGGAGGACGCCCCGCAG ACCCCCCGGCCAGUGCCAGAGAUCGUGCCCAG CUUCAUCAACAAGGAUACCGAGACAAUUAACA UGAUGAGCGAGUUCGUGGCCAACCUGCCCCAG GAGCUGAAGCUGACCCUGAGCGAGAUGCAGCC CGCACUGCCCAACUCCAGCAGCACGUGCCUG UGCUGAAGGACAGCAGCCUGCUGUUCGAGGAG UUCAAGAAGCUGAUCCGGAACCGGCAGAGCGA GGCCGCCGACUCCAGCCCAUCUGAACUGAAGU ACCUGGGCCUGGACACCCACAGCCGCAAGAAG CGCCAGCUGUACUCUGCCCUGGCCAACAAGUG CUGCCACGUGGGAUGCACAAAGCGUUCCCUGG CCCGGUUCUGC | 5' UTR 1 | 3' UTR 1 | 422 |
| Construct 98 | AUGCCCCGGCUUUUCUUCUUCCACCUCCUCGG CGUGUGCCUCCUCCUCAACCAGUUCAGCCGGG CCGUGGCCGACAGCUGGAUGGAGGAGGUGAUC AAGCUUUGCGGCCGGGAGCUCGUGCGGGCCCA GAUCGCCAUCUGCGGCAUGAGCACCUGGAGCG AGCCCAAGAGCAGCGACAAGACCCACACCAGC CCACCUAGCCCGGCACCCGAGCUCCUGGGCGG CAGCAGCGUGUUCCUGUUCCCUCCAAAGCCCA AGGACACCCUGUACAUCACCCGGGAGCCCGAG GUGACCUGCGUGGUGGUGGACGUGAGCCACGA GGACCCUGAGGUGAAGUUCAACUGGUACGUG GACGGCGUGGAGGUGCACAACGCCAAGACCAA GCCCCGGGAGGAGCAGUACAACAGCACCUACC GGGUGGUGAGCGUGCUGACCGUGCUGCACCAG GACUGGCUGAACGGCAAGGAGUACAAGUGCA AGGUGAGCAACAAGGCCCUGCCAGCCCCCAUC GAGAAGACCAUCAGCAAGGCCAAGGGCCAGCC UCGCGAGCCUCAGGUGUACACCCUGCCUCCAU CCCGGGACGAGCUGACCAAGAACCAGGUGAGC CUGACCUGCCUGGUGAAGGGCUUCUACCCCAG CGACAUCGCCGUGGAGUGGGAGAGCAACGGCC AGCCAGAGAACAACUACAAGACCACCCCUCCC | 5' UTR 1 | 3' UTR 1 | 423 |
| | GUGCUGGACAGCGACGGCAGCUUCUUCCUGUA CAGCAAGCUCACCGUGGACAAGAGCCGGUGGC AGCAGGGCAACGUGUUCAGCUGCAGCGUGAUG CACGAAGCCCUACACAACCACUACACCCAGAA GUCCCUGAGCUUGAGCCCCGGCAAGCGGAAGA AGCGCUCCUUGUCCCAGGAGGACGCCCCGCAA ACCCCCCGGCCAGUGCCGAGAUCGUGCCCAG CUUCAUCAACAAGGAUACAGAGACAAUUAACA UGAUGAGCGAGUUCGUGGCCAACCUGCCCCAG GAGCUGAAGCUCACACUGAGCGAGAUGCAGCC CGCCCUGCCAACUCCAGCAGCACGUGCCUG UGCUGAAGGACAGCAGCCUGCUGUUCGAGGAG UUCAAGAAGCUGAUCCGGAACCGGCAGAGCGA GGCCGCCGACUCCUCCCCAAGCGAGCUCAAGU ACCUGGGCCUGGACACCCACAGCAGAAAGAAG AGGCAGCUCUACAGCGCCCUGGCCAACAAGUG CUGCCACGUGGGCUGUACCAAGAGAAGCCUGG CCCGGUUCUGC | | | |
| Construct 99 | AUGCCCAGACUGUUCUUCUUCCACUUAUUGGG CGUGUGCUUGCUUCUCAACCAGUUCAGCCGGG CCGUGGCCGACAGCUGGAUGGAGGAGGUCAUC AAGCUCUGCGGCCGGGAGCUCGUCGCCGCCCA GAUCGCCAUCUGCGGCAUGUCCACCUGGUCCG AGCCCAAGUCCUCCGACAAGACCCACACCUCC CCGCCUUCCCCUGCACCCGAGCUCCUCGGCGG CUCCUCCGUCUUCCUCUUCCCUAAGCCCA AGGACACCCUCUACAUCACCCGCGAGCCCGAG GUCACCUGCGUCGUCGUCGACGUCUCCCACGA GGACCCUGAGGUGAAGUUCAACUGGUACGUCG ACGGCGUCGAGGUCCACAACGCCAAGACCAAG CCCCGCGAGGAGCAGUACAACUCCACCUACCG CGUCGUCUCCGUCCUCACCGUCCUCCACCAGG ACUGGCUCAACGGCAAGGAGUACAAGUGCAAG GUGUCCAACAAGGCCCUGCCUGCCCCAAUCGA GAAGACCAUCUCCAAGGCCAAGGGCCAGCCCAC GGGAACCUCAGGUCUACACCCUGCCUCCUAGC CGCGACGAGCUCACCAAGAACCAGGUGUCCCU CACCUGCCUCGUCAAGGGCUUCUACCCCUUCUG AUAUCGCCGUGGAGUGGGAGUCCAACGGCCAG CCUGAGAACAACUACAAGACCACCCCUCCCGU CCUCGACUCCGACGGCUCCUUCUUCCUGUACU CCAAGCUGACCGUGGACAAGUCCCGCUGGCAG CAGGGCAACGUCUUCUCCUGCUCCGUCAUGCA CGAGGCUCUGCACAACCACUACACCCAGAAGU CCCUGAGCCUGAGCCCCGGCAAGCGCAAGAAG AGAAGCCUGUCACAGGAGGACGCCCCCAGAC CCCGCCCUGUGCCGAGAUCGUGCCCCUCCU UCAUCAAUAAGGACACGGAGACAAUCAACAUG AUGUCCGAGUUCGUCGCCAACCUGCCGCAGGA GCUGAAGCUCACCCUCUCCGAGAUGCAGCCCG CCCUUCCGCAGCUCCAGCAGCACGUGCCUGUC CUGAAGGACUCCUCCCUCCUCUUCGAGGAGUU CAAGAAGCUCAUCCGCAACCGCCAGUCCGAGG CCGCCGAUAGCUCGCCUUCCGAGCUAAAGUAC CUCGGCCUCGACACCCACUCCCGGAAGAAGAG GCAGUAUAUAGCCCUCGCCAACAAGUGCU GCCACGUCGGCUGCACCAAGAGGAGCCUGGCC CGCUUCUGC | 5' UTR 1 | 3' UTR 1 | 424 |
| Construct 100 | AUGCCCCGUCUGUUCUUCUUCCACCUUCUCGG CGUGUGCCUCCUACUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGUCCACCUGGUCCG AGCCCAAGUCCUCCGACAAGACCCACACCUCG CCUCCUAGCCCAGCCCCGAGCUCCUCGGCGG CUCCUCCGUCUUCCUCUUCCCCACCGAAGCCCA AGGACACCCUCUACAUCACCCGCGAGCCCGAG GUCACCUGCGUCGUCGUCGACGUCUCCCACGA GGACCCAGAGGUGAAGUUCAACUGGUACGUCG ACGGCGUCGAGGUCCACAACGCCAAGACCAAG CCCCGCGAGGAGCAGUACAACUCCACCUACCG CGUCGUCUCCGUCCUCACCGUCCUCCACCAGG | 5' UTR 1 | 3' UTR 1 | 425 |

TABLE 7-continued

RNA Sequences

| Name | Sequence | 5' UTR | 3' UTR | SEQ ID NO: |
|---|---|---|---|---|
| | ACUGGCUCAACGGCAAGGAGUACAAGUGCAAG<br>GUGUCCAACAAGGCCCUGCCAGCCCCAAUCGA<br>GAAGACCAUCUCCAAGGCCAAGGGCCAACCUA<br>GAGAGCCUCAGGUCUACACCUUGCGCUCCAAGU<br>CGCGACGAGCUCACCAAGAACCAGGUGUCCCU<br>CACCUGCCUCGUCAAGGGCUUCUACCCAAGCG<br>ACAUCGCCGUCGAGUGGGAGUCCAACGGCCAG<br>CCUGAGAACAACUACAAGACCACCCCGCCCGU<br>CCUCGACUCCGACGGCUCCUUCUUCCUGUACU<br>CCAAGCUGACCGUCGACAAGUCCCGCUGGCAG<br>CAGGGCAACGUCUUCUCCUGCUCCGUCAUGCA<br>CGAGGCUCUGCACAACCACUACACCCAGAAGU<br>CCCUGAGCCUGAGCCCCGGCAAGCGCAAGAAG<br>AGAAGCCUCAGCCAGGAGGACGCCCCCCAGAC<br>CCCUAGACCGGUCGCCGAGAUCGUCCCCUCCU<br>UCAUCAAUAAGGACACAGAGACAAUCAACAUG<br>AUGUCCGAGUUCGUCGCCAAUCUGCCUCAGGA<br>GCUUAAGCUCACCCUCUCCGAGAUGCAGCCCG<br>CUUUGCUCAGCUCCAGCAGCACGUGCCAGCUGUG<br>CUGAAGGACUCCUCCUCCUCUUCGAGGAGUU<br>CAAGAAGCUCAUCCGCAACCGCCAGUCCGAGG<br>CCGCCGACUCAAGCCCAUCCGAGCUGAAGUAC<br>CUCGGCCUCGACACCCACUCCCGGAAGAAGAG<br>GCAGCUCUACUCCGCCCUCGCCAACAAGUGCU<br>GCCACGUCGGCUGCACCAAGCGGUCCCUCGCC<br>CGCUUCUGC | | | |
| Construct 101 | AUGCCCCGGUUGUUCUUCUUCCACCUUUUGGG<br>CGUGUGCCUUCUCUUGAACCAGUUCAGCCGGG<br>CCGUGGCCGACAGCUGGAUGGAGGAGGUCAUC<br>AAGCUCUGCGGCCGCGAGCUCGUCCGCGCCCA<br>GAUCGCCAUCUGCGGCAUGAGCACCUGGAGCG<br>AGCCCAAGUCCUCCGACAAGACCCACACCCUCU<br>CCUCCAAGCCCUGCGCCCGAGCUCCUCGGCGG<br>CUCCUCCGUCUUCCUCUUCCCACCAAAGCCCA<br>AGGACACCUCUACAUCACCCGCGAGCCCGAG<br>GUCACCUGCGUCGUCGUCGACGUCUCCCACGA<br>GGACCCAGAGGUCAAGUUCAACUGGUACGUCG<br>ACGGCGUCGAGGUCCACAACGCCAAGACCAAG<br>CCCCGCGAGGAGCAGUACAACAGCACCUACCG<br>CGUCGUCUCCGUCCUCACCGUCCUCCACCAGG<br>ACUGGCUCAACGGCAAGGAGUACAAGUGCAAG<br>GUGUCCAACAAGGCCCUCCCAGCCCCAAUCGA<br>GAAGACCAUCUCCAAGGCCAAGGGCCAACCUA<br>GAGAACCACAGGCUACACACUCCCUCCUAGC<br>CGCGACGAGCUCACCAAGAACCAGGUGUCCCU<br>CACCUGCCUCGUCAAGGGCUUCUACCCAUCCG<br>AUAUCGCCGUCGAGUGGGAGUCCAACGGACAG<br>CCGGAGAACAACUACAAGACCACACCUCCCGU<br>CCUCGACUCCGACGGCUCCUUCUUCCUGUACU<br>CCAAGCUGACCGUGGACAAGUCCCGCUGGCAG<br>CAGGGCAACGUCUUCUCCUGCUCCGUCAUGCA<br>CGAGGCCCUGCACAACCACUACACCCAGAAGU<br>CCCUCUCCCUGAGCCCCGGCAAGCGCAAGAAG<br>AGAAGCUUAGCCAGGAGGACGCCCCCCAGAC<br>CCCUAGACCGGUCGCCGAGAUCGUCCCCUCCU<br>UCAUCAACAAGGAUACAGAGACGAUCAACAUG<br>AUGUCCGAGUUCGUCGCCAAUCUGCCACAGGA<br>GCUGAAGCUGACACUCUCCGAGAUGCAGCCCG<br>CCCUGCUCAGCUCCAGCAGCACGUGCCAGUG<br>CUGAAGGACUCCUCUCCUCAUUACGCAGGAGUU<br>CAAGAAGCUCAUCCGCAACCGCCAGUCCGAGG<br>CCGCCGACUCUAGCCCUUCCGAGCUCAAGUAC<br>CUCGGCCUCGACACCCACUCCCGGAAGAAGCG<br>GCAGCUGUAUCCGCCCUCGCCAACAAGUGCU<br>GCCACGUCGGCUGCACCAAGCGGUCCCUUGCC<br>CGCUUCUGC | 5' UTR 1 | 3' UTR 1 | 426 |
| Construct 102 | AUGCCCCGGCUAUUCUUCUUCCACUUACUCGG<br>CGUGUGCCUCCUCUUGAACCAGUUCAGCCGGG<br>CCGUGGCCGACAGCUGGAUGGAGGAGGUGAUC<br>AAGCUUUGCGGCCGGGAGCUUGUGCGGGCCCA<br>GAUCGCCAUCUGCGGCAUGAGCACCUGGAGCG<br>AGCCCAAGAGCAGCGACAAGACCCACACCAGC | 5' UTR 1 | 3' UTR 1 | 427 |
| | CCUCCUUCCCCUGCCCCCGAGUUGCUGGGAGG<br>CAGCAGCGUGUUCCUGUUCCCACCGAAGCCCA<br>AGGACACCCUGUACAUCACCCGGGAGCCCGAG<br>GUGACCUGCGUGGUGGUGGACGUGAGCCACGA<br>GGACCCAGAGGUGAAGUUCAACUGGUACGUG<br>GACGGCGUGGAGGUGCACAACGCCAAGACCAA<br>GCCCCGGGAGGAGCAGUACAACAGCACCUACC<br>GGGUGGUGAGCGUGCUGACCGUGCUGCACCAG<br>GACUGGCUGAACGGCAAGGAGUACAAGUGCA<br>AGGUGAGCAACAAGGCCCUGCCAGCCCCUAUC<br>GAGAAGACCAUCAGCAAGGCCAAGGGCCAGCC<br>UAGGGAGCCACAGGUGUACACCCUGCCACCUA<br>GCCGGGACGAGCUGACCAAGAACCAGGUGAGC<br>CUGACCUGCCUGGUGAAGGGCUUCUACCCCAG<br>CGACAUCGCCGUGGAGUGGGAGAGCAACGGC<br>AGCCGGAGAACAACUACAAGACCACCCCACCC<br>GUGCUGGACAGCGACGGCAGCUUCUUCCUGUA<br>CAGCAAGCUGACGGUGGACAAGAGCCGGUGGC<br>AGCAGGGCAACGUGUUCAGCUGCAGCGUGAUG<br>CACGAGGCUCUGCACAACCACUACACCCAGAA<br>GAGUUUAAGCUUGUCACCCGGCAAGCGGAAGA<br>AGCGGUCCCUGAGCCAGGAGGACGCCCCUCAG<br>ACCCCCCAGACCUGUUGCCGAGAUCGUGCCCAG<br>CUUCAUCAAUAAGGAUACCGAAACCAUCAACA<br>UGAUGAGCGAGUUCGUGGCCAACCUGCCCCAG<br>GAGCUGAAGCUGACCCUGAGCGAGAUGCAGCC<br>CGCCCUCCUCAGUUGCAGCAGCACGUGCCUG<br>UGCUGAAGGACAGCAGCUGCUGUUCGAGGAG<br>UUCAAGAAGCUGAUCCGGAACCGGCAGAGCGA<br>GGCCGCCGACUCCUCCCCUAGCGAGCUCAAGU<br>ACCUGGGCCUGGACACCCACAGCAGAAAGAAG<br>AGAGCAGCUCUACAGCGCCCUGGCCAACAAGUG<br>CUGCCACGUGGGUUGCACCAAGCGCAGCCUGG<br>CCCGGUUCUGC | | | |
| Construct 103 | AUGCCCCGGUUAUUCUUCUUCCACCUCCUCGG<br>CGUGUGCCUCUUGCUCAACCAGUUCAGCCGGG<br>CCGUGGCCGACAGCUGGAUGGAGGAGGUGAUC<br>AAGCUCUGCGGCCGGGAGUUGGUGCGGGCCCA<br>GAUCGCCAUCUGCGGCAUGAGCACCUGGAGCG<br>AGCCCAAGAGCAGCGACAAGACCCACACCUCC<br>CCUCCUAGCCCGGCGCCCGAGCUGCUGGGAGG<br>CAGCAGCGUGUUCCUGUUCCCUCCUAAGCCCA<br>AGGACACCCUGUACAUCACCCGGGAGCCCGAG<br>GUGACCUGCGUGGUGGUGGACGUGAGCCACGA<br>GGACCCAGAGGUGAAGUUCAACUGGUACGUG<br>GACGGCGUGGAGGUGCACAACGCCAAGACCAA<br>GCCCCGGGAGGAGCAGUACAACAGCACCUACC<br>GGGUGGUGAGCGUGCUGACCGUGCUGCACCAG<br>GACUGGCUGAACGGCAAGGAGUACAAGUGCA<br>AGGUGAGCAACAAGGCCCUGCCUGCCCUAUC<br>GAGAAGACCAUCAGCAAGGCCAAGGGCCAGCC<br>ACGCGAGCCUCAGGUGUACACCCUGCCACCUA<br>GCCGGGACGAGCUGACCAAGAACCAGGUGAGC<br>CUGACCUGCCUGGUGAAGGGCUUCUACCCCAG<br>CGACAUCGCCGUGGAGUGGGAGAGCAACGCC<br>AGCCUGAGAACAACUACAAGACCACCCCCUCC<br>GUGCUGGACAGCGACGGCAGCUUCUUCCUGUA<br>CAGCAAGCUGACGGUGGACAAGAGCCGGUGGC<br>AGCAGGGCAACGUGUUCAGCUGCAGCGUGAUG<br>CACGAGGCUCUGCACAACCACUACACCCAGAA<br>GUCACUGAGCCUGUCACCCGGCAAGCGGAAGA<br>AGAGAAGCCUGUCCAGGAGGACGCACCUCAG<br>ACCCCCGGCCUGUGGCCGAGAUCGUGCCCAG<br>CUUCAUCAAUAAGGAUACCGAAACCAUCAACA<br>UGAUGAGCGAGUUCGUGGCCAACCUGCCCCAG<br>GAGCUGAAGCUGACCCUGAGCGAGAUGCAGCC<br>CGCUCUGCUCAGCUUCAGCAGCACGUGCCUG<br>UCCUGAAGGACAGCAGCCUGCUGUUCGAGGAG<br>UUCAAGAAGCUGAUCCGGAACCGGCAGAGCGA<br>GGCCGCCGACUCUAGCCCCAGCGAACUCAAGU<br>ACCUGGGCCUGGACACCCACAGCAGAAAGAAG<br>CGCAGCUCUACAGCGCCCUGGCCAACAAGUG<br>CUGCCACGUGGGAUGCACCAAGCGAAGCCUGG | 5' UTR 1 | 3' UTR 1 | 428 |

TABLE 7-continued

RNA Sequences

| Name | Sequence | 5' UTR | 3' UTR | SEQ ID NO: |
|---|---|---|---|---|
| | CCCGGUUCUGC | | | |
| Construct 104 | AUGCCCAGACUCUUCUUCUUCCACCUUUUGGG CGUGUGCCUCCUCCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGUCCACCUGGUCCG AGCCCAAGUCCUCCGACAAGACCCACACCUCC CCGCCUAGCCCUGCCCCCGAGCUCCUCGGCGG CUCCUCCGUCUUCCUCUUCCCUCCAAAGCCCA AGGACACCCUCUACAUCACCCGCGAGCCCGAG GUCACCUGCGUCGUCGUCGACGUCUCCCACGA GGACCCGGAGGUGAAGUUCAACUGGUACGUCG ACGGCGUCGAGGUCCACAACGCCAAGACCAAG CCCCGCGAGGAGUACAACUCCACCUACCG CGUCGUCUCCGUCCUCACCGUCCUCCACCAGG ACUGGCUCAACGGCAAGGAGUACAAGUGCAAG GUAUCCAACAAGGCCCUGCCUGCUCCUAUCGA GAAGACCAUCUCCAAGGCCAAGGGCCAACCUA GAGAGCCACAGGUCUACACCCUGCCUCCGUCC CGCGACGAGCUCACCAAGAACCAGGUGUCCCU CACCUGCCUCGUCAAGGGCUUCUACCCUAGCG ACAUCGCCGUCGAGUGGGAGUCCAACGGCCAG CCUGAGAACAACUACAAGACCACCCCUCCCGU CCUCGACUCCGACGGCUCCUUCUUCCUUUACU CCAAGCUGACCGUCGACAAGUCCCGCUGGCAG CAGGGCAACGUCUUCUCCUGCUCCGUCAUGCA CGAGGCCCUCCACAACCACUACACCCAGAAGU CCCUCUCGCUCUCCCCGGCAAGCGCAAGAAG AGAUCCCUGUCGCAGGAGGACGCCCCCCAGAC CCCUAGACCGGUCGCCGAGAUCGUCCCCUCCU UCAUCAAUAAGGACACAGAAACCAUCAACAUG AUGUCCGAGUUCGUCGCCAACUUGCCACAGGA GCUGAAGCUCACCCUCUCCGAGAUGCAGCCCG CCCUCCCACAGCUCCAGCAGCACGUGCCUGUC CUCAAGGACUCCUCCCUCUUCGAGGAGUU CAAGAAGCUCAUCCGCAACGCCAGUCCGAGG CCGCCGAUAGCUCACCUUCCGAGCUCAAGUAC CUCGGCCUCGACACCCACUCCAGAAAGAAGCG GCAGCUGUACACCGCCCUCGCCAACAAGUGCU GCCACGUCGGCUGCACCAAGAGAAGCCUCGCC CGCUUCUGC | 5' UTR 1 | 3' UTR 1 | 429 |
| Construct 105 | AUGCCCCGACUGUUCUUCUUCCACUUGCUUGG CGUGUGCCUCCUCUUUAAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGUCCACCUGGUCCG AGCCCAAGUCCUCCGACAAGACCCACACCUCU CCGCCAAGCCCAGCUCCCGAGCUCCUCGGCGG CUCCUCCGUCUUCCUCUUCCCUCCUAAGCCCA AGGACACCCUCUACAUCACCCGCGAGCCCGAG GUCACCUGCGUCGUCGUCGACGUCUCCCACGA GGACCCAGAGGUCAAGUUCAACUGGUACGUCG ACGGCGUCGAGGUCCACAACGCCAAGACCAAG CCCCGCGAGGAGCAGUACAACUCCACCUACCG CGUCGUCUCCGUCCUCACCGUCCUCCACCAGG ACUGGCUCAACGGCAAGGAGUACAAGUGCAAG GUGUCCAACAAGGCCCUGCCUGCCCCUAUCGA GAAGACCAUCUCCAAGGCCAAGGGCCAGCCUA GAGAGCCUCAGGUCUACACCCUGCCUCCGUCG CGCGACGAGCUCACCAAGAACCAGGUGUCCCU CACCUGCCUCGUCAAGGGCUUCUACCCAUCCG ACAUCGCCGUCGAGUGGGAGUCCAACGGCCAA CCUGAGAACAACUACAAGACCACCCCUCCCGU CCUCGACUCCGACGGCUCCUUCUUCCUGUACU CCAAGCUGACCGUGGACAAGUCCCGCUGGCAG CAGGGCAACGUCUUCUCCUGCUCCGUCAUGCA CGAGGCCCUGCACAACCACUACACCCAGAAGU CCCUCAGCUUGUCCCCGGCAAGCGCAAGAAG CGGUCCCUGUCCCAGGAGGACGCCCCCCAGAC CCCUAGACCUGUCGCCGAGAUCGUCCCCUCCU UCAUCAAUAAGGAUACCGAGACUAUCAACAUG AUGUCCGAGUUCGUCGCCAACCUCCCACAGGA | 5' UTR 1 | 3' UTR 1 | 430 |
| | GCUGAAGCUCACCCUCUCCGAGAUGCAGCCCG CUCUGCCACAGCUCCAGCAGCACGUGCCCUGUG CUCAAGGACUCCUCCCUCUUCGAGGAGUU CAAGAAGCUCAUCCGCAACGCCCAGUCCGAGG CCGCCGACUCCAGCCCUAGCGAGCUCAAGUAC CUCGGCCUCGACACCCACUCCAGGAAGAAGAG ACAGCUCUACACGGCCCUCGCCAACAAGUGCU GCCACGUCGGCUGCACCAAGAGAAGCCUGGCC CGCUUCUGC | | | |
| Construct 106 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUGAUC AAGCUGUGCGGCCGGGAGCUGGUGCGGGCCCA GAUCGCCAUCUGCGGCAUGAGCACCUGGAGCG AGCCCAAGAGCAGCGACAAGACCCACACCAGC CCCCCCAGCCCCGCCCCGAGCUGCUGGGCGG CAGCAGCGUGUUCCUGUUCCCCCCCAAGCCCA AGGACACCCUGUACAUCACCCGCGAGCCCGAG GUGACCUGCGUGGUGGUGGACGUGAGCCACGA GGACCCCGAGGUGAAGUUCAACUGGUACGUGG ACGGCGUGGAGGUGCACAACGCCAAGACCAAG CCCCGGGAGGAGCAGUACAACAGCACCUACCG GGUGGUGAGCGUGCUGACCGUGCUGCACCAGG ACUGGCUGAACGGCAAGGAGUACAAGUGCAA GGUGAGCAACAAGGCCCUGCCCGCCCCCAUCG AGAAGACCAUCAGCAAGGCCAAGGGCCAGCCC CGGGAGCCCCAGGUGUACACCCUGCCCCCCAG CCGGGACGAGCUGACCAAGAACCAGGUGAGCC UGACCUGCCUGGUGAAGGGCUUCUACCCCAGC GACAUCGCCGUGGAGUGGGAGAGCAACGGCCA GCCCGAGAACAACUACAAGACCACCCCCCCCG UGCUGGACAGCGACGGCAGCUUCUUCCUGUAC AGCAAGCUGACCGUGGACAAGAGCCGGUGGCA GCAGGGCAACGUGUUCAGCUGCAGCGUGAUGC ACGAGGCCCUGCACAACCACUACACCCAGAAG AGCCUGAGCCUGAGCCCCGGCAAGCGGAAGAA GCGGAGCCUGAGCCAGGAGGACGCCCCCCAGA CCCCCCGGCCCGUGGCCGAGAUCGUGCCCAGC UUCAUCAACAAGGACACCGAGACCAUCAACAU GAUGAGCGAGUUCGUGGCCAACCUGCCCCAGG AGCUGAAGCUGACCCUGAGCGAGAUGCAGCCC GCCCUGCCCCAGCUGCAGCAGCACGUGCCCGU GCUGAAGGACAGCAGCCUGCUGUUCGAGGAGU UCAAGAAGCUGAUCCGGAACGGCAGAGCGAG GCCGCCGACAGCAGCCCCAGCGAGCUGAAGUA CCUGGGCCUGGACACCCACAGCGGAAGAAGC GGCAGCUGUACACCGCCCUCGCCAACAAGUGC UGCCACGUGGGCUGCACCAAGCGGAGCCUGGC CCGGUUCUGC | 5' UTR 1 | 3' UTR 1 | 431 |
| Construct 107 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUGAUC AAGCUGUGCGGGAGGGAGCUGGUGAGGGCGC AGAUCGCGAUCUGCGGGAUGCACGUGGAGGC GAGCCGAAGAGCAGCGACAAGACCCACACGAG CCCGCCGAGCCCGGCGCCGGAGCUGCUGGGGG GGAGCAGCGUGUUCCUGUUCCCGCCGAAGCCG AAGGACACGCUGUACAUCACGAGGGAGCCGGA GGUGACGUGCGUGGUGGUGGACGUGAGCCAC GAGGACCCGGAGGUGAAGUUCAACUGGUACG UGGACGGGGUGGAGGUGCACAACGCGAAGAC GAAGCCGAGGGAGGAGCAGUACAACAGCACGU ACAGGGUGGUGAGCGUGCUGACCGUGCUGCAC CAGGACUGGCUGAACGGGAAGGAGUACAAGU GCAAGGUGAGCAACAAGGCGCUGCCGGCGCCG AUCGAGAAGACGAUCAGCAAGGCGAAGGGGC AGCCGAGGGAGCCGCAGGUGUACACGCUGCCG CCGAGCAGGGACGAGCUGACGAAGAACCAGGU GAGCCUGACGUGCCUGGUGAAGGGGUUCUACC CGAGCGACAUCGCGGUGGAGUGGGAGAGCAAC GGGCAGCCGGAGAACAACUACAAGACGACGCC GCCGGUGCUGGACAGCGACGGGAGCUUCUUCC | 5' UTR 1 | 3' UTR 1 | 432 |

TABLE 7-continued

RNA Sequences

| Name | Sequence | 5' UTR | 3' UTR | SEQ ID NO: |
|---|---|---|---|---|
| | UGUACAGCAAGCUGACGGUGGACAAGAGCAG | | | |
| | GUGGCAGCAGGGGAACGUGUUCAGCUGCAGC | | | |
| | UGAUGCACGAGGCGCUGCACAACCACUACACG | | | |
| | CAGAAGAGCCUGAGCCUGAGCCCGGGGAAGAG | | | |
| | GAAGAAGAGGAGCCUGAGCCAGGAGGACGCGC | | | |
| | CGCAGACGCCGGGCCGUGGCGGAGAUCGUG | | | |
| | CCGAGCUUCAUCAACAAGGACACGGAGACGAU | | | |
| | CAACAUGAUGAGCGAGUUCGUGGCGAACCUGC | | | |
| | CGCAGGAGCUGAAGCUGACGCUGAGCGAGAUG | | | |
| | CAGCCGGCGCUGCCGCAGCUGCAGCAGCACGU | | | |
| | GCCGGUGCUGAAGGACAGCAGCCUGCUGUUCG | | | |
| | AGGAGUUCAAGAAGCUGAUCAGGAACAGGCA | | | |
| | GAGCGAGGCGGCGGACAGCAGCCCGAGCGAGC | | | |
| | UGAAGUACCUGGGGCUGGACACGCACAGCAGG | | | |
| | AAGGAGAGGCAGCUGUACAGCGCGCUGGCGAA | | | |
| | CAAGUGCUGCCACGUGGGGUGCACGAAGAGGA | | | |
| | GCCUGGCGAGGUUCUGC | | | |
| Construct 108 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCUGGUCCG AGCCCAAGUCCUCCGACAAGACCCACACCUCC CCCCCCUCCCCCGCCCCCGAGCUCCUCGGCGG UCCUCCGUCUUCCUCUUCCCCCCAAGCCCAA GGACACCUACAUCACCCGCGAGCCCGAGG UCACCUGCGUCGUCGUCGACGUCUCCCACGAG GACCCCGAGGUCAAGUUCAACUGGUACGUCGA CGGCGUCGAGGUCCACAACGCCAAGACCAAGC CCCGCGAGGAGCAGUACAACUCCACCUACCGC GUCGUCUCCGUCCUCACCGUCCUCCACCAGGA CUGGCUCAACGGCAAGGAGUACAAGUGCAAGG UCUCCAACAAGGCCCUCCCCGCCCCCAUCGAG AAGACCAUCUCCAAGGCCAAGGGCCAGCCCCG CGAGCCCCAGGUCUACACCCUGCCCCCCUCCC GCGACGAGCUCACCAAGAACCAGGUCUCCCUC ACCUGCCUCGUCAAGGGCUUCUACCCCUCCGA CAUCGCCGUCGAGUGGGAGUCCAACGGCCAGC CCGAGAACAACUACAAGACCACCCCCCCCGUC CUCGACUCCGACGGCUCCUUCUUCCUCUACUC CAAGCUCACCGUCGACAAGUCCCGCUGGCAGC AGGGCAACGUCUUCUCCUGCUCCGUCAUGCAC GAGGCCCUCCACAACCACUACACCCAGAAGUC CCUCUCCCUCUCCCCCGGCAAGCCCAAGAAGC GCUCCCUCUCCAGGAGGACGCCCCCCAGACC CCCCGCCCCGUCGCCGAGAUCGUCCCCUCCUU CAUCAACAAGGACACGAGACCAUCAACACGA UGUCCGAGUUCGUCGCCAACCUCCCCCAGGAG CUCAAGCUCACCCUCUCCGAGAUGCAGCCCGC CCUCCCCCAGCUCCAGCAGCACGUCCCCGUCC UCAAGGACUCCUCCCUCUCGAGGAGUUC AAGAAGCUCAUCCGCAACCGCCAGUCCGAGGC CGCCGACUCCUCCCCCUCCGAGCUCAAGUACC UCGGCCUCGACACCCACUCCCGCAAGGAGCGC CAGCUCUACUCCGCCCUCGCCAACAAGUGCUG CCACGUCGGCUGCACCAAGCGCUCCCUCGCCC GCUUCUGC | 5' UTR 1 | 3' UTR 1 | 433 |
| Construct 109 | AUGCCCCGCCUGUUCUUCUUCCACCUCCUCGG CGUCUGCCUCCUCCUCAACCAGUUCUCCCGCG CCGUGGCGGACAGCUGGAUGGAGGAGGUGAU CAAGCUCUGCGGCCGCGAGCUCGUGCGCGCCC AGAUCGCCAUUUGCGGCAUGGAGCCCAAGAGC UCCGACAAGACCACCAGCCCGCCCAGCC CGCCCCUGAGCUGCUGGGCGGAUCCAGCGUCU UCCUGUUCCCCCCAAGCCCAAGGACACCCUG UACAUCACAAGGGAGCCCGAGGUCACCUGCGU GGUGGUGGACGUGUCCCAUGAAGACCCCGAGG UGAAAUUUAACUGGUACGUAGACGGCGUGGA GGUGCACAACGCCAAGACCAAGCCCAGGGAG AGCAGUACAACAGCACCUACCGGGUGGUAAGC GUCCUGACCGUGCUGCACCAGGACUGGCUGAA CGGCAAGGAGUAUAAGUGCAAAGUGAGCAAC | 5' UTR 1 | 3' UTR 1 | 434 |
| | AAGGCCCUGCCCGCCCCCAUCGAGAAGACCAU CAGCAAGGCCAAGGGGCAGCCCCGGGAGCCAC AGGUGUACACCCUGCCCCCCAGCAGGGACGAG CUGACCAAGAACCAGGUGAGCUCUCACAUGCC GGUUAAGGGCUUCUACCCCAUCCGACAUCGCCG UGGAGUGGGAAAGCAACGGUCAGCCCGAGAAC AACUACAAGACCACGCCCCCCGGUGCUGGACUC CGACGGCAGCUUCUUCCUGUACUCCAAGCUCA CCGUGGACAAGUCCAGGUGGCAGCAGGGGAAC GUGUUCAGCUGCAGCGUGAUGCAUGAGGCACU GCACAACCACUACACGCAGAAGUCCCUGUCUC UGAGCCCAGGCAAGCGCAAGAGCACCUGGAGC AAGAGGUCCCUGAGCCAAGAGGACGCCCCCCA GACCCCCCGGCCCUGUGGCCGAGAUCGUGCCCA GCUUCAUCAACAAGGACACCGAGACGAUCAAC AUGAUGAGCGAAUUUGUGGCCAAUCUGCCCCA GGAGCUGAAGCUCACCCUCUCCGAAAUGCAGC CCGCCCUCCCCCAACUGCAACAACACGUCCCC GUGCUGAAGGACAGCAGCCUGCUGUUUGAGG AAUUUAAGAAGCUCAUCAGAAACAGACAGAG CGAGGCCGCGGACUCCAGCCCCAGCGAGCUGA AGUACCUGGGGCUGGACACCCAUAGCAGGAAG GAGCGGCAGCUGUACAGCGCCCUCGCCAACAA GUGCUGCCACGUGGGCUGCACCAAGAGAAGCC UGGCCAGGUUCUGC | | | |
| Construct 110 | AUGCCCCGACUCUUCUUCUUCCACCUCCUCGG CGUGUGCCUCCUCCUCAACCAGUUCUCUCGAG CCGUGGCCGAUUCCUGGAUGGAGGAGGUGAUC AAGCUCUGCGGCAGAGAACUCGUGAGAGCCCA GAUCGCCAUUUGUGGGAUGGAGCCAAGAGCA GCGACAAGACCCAUACUAGCCCACCCUCCCCCC GCCCCCGAGCUGCUGGGGGGCAGCAGCGUGUU CCUGUUUCCCCCGAAGCCCAAGGACACCCUGU ACAUCACCCGGGAGCCCGAGGUGACCUGCGUG GUUGUCGACGUGUCACACGAAGACCCGAGGU GAAGUUCAACUGGUACGUGGACGGCGUCGAG GUGCACAACGCCAAGACCAAGCCCAGGGAGGA GCAGUACAACAGCACGUACAGAGUGGUGUCAG UCCUGACCGUCCUCCACCAGGAUUGGCUCAAC GGCAAAGAGUACAAGUGCAAGGUGAGCAACA AGGCCCUGCCCGCCCCCAUCGAGAAGACAAUC UCCAAGGCCAAGGGCCAGCCGAGGGAGCCCCA GGUGUAUACCCUGCCCCCUCAAGGGACGAGC UGACCAAGAAUCAGGUGUCCCUCACAUGCCUG GUGAAGGGGUUCUACCCCAGCGACAUCGCCGU GGAGUGGGAGAGCAACGGACAGCCCGAGAACA ACUACAAGACCACACCCCCCGUGCUGGACAGC GAUGGAAGUUCUUCCUGUAUAGCAAACUGA CCGUGGACAAAUCACGGUGGCAGCAGGGCAAC GUGUUCAGCUGCAGCGUGAUGCACGAAGCCCU GCACAACCACUACACCCAGAAGUCAUUAUCUC UGAGCCCCGGCAAGAGAAAGAGCACGUGGAGC AAGAGGAGCCUCUCCAGGAGGACGCCCCCCCA GACCCCCCGGCCCUGUGGCCGAGAUCGUGCCCU CCUUUAUUAACAAGGACACCGAGACAAUCAAC AUGAUGUCCGAGUUCGUCGCCAAUCUGCCCCA GGAGCUCAAGCUCACCCUGAGCGAGAUGCAGC CCGCUCUGCCCCAGCUGCAGCAACACGUGCCC GUGCUGAAGGACAGCAGCCUGCUGUUCGAGGA GUUCAAGAAGCUGAUCCGCAACCGGCAAAGCG AGGCCGCUGACAGCUCGCCCAGCGAGCUGAAG UACUGGGGCUGGACACCCACAGCCGGAAGAA GCGGCAGCUGUACAGCGCCCUGGCCAACAAGU GCUGCCACGUGGGCUGCACUAAGCGGAGCCUG GCCAGAUUUUGC | 5' UTR 1 | 3' UTR 1 | 435 |
| Construct 111 | AUGCCCAGACUGUUCUUCUUUCACCUCCUCGG CGUGUGUCUUUUACUCAACCAAUUUAGCAGG CCGUGGCCGACUUUGGAUGGAGGAGGUGAUC AAGCUCUGGGCCGCGAGCUUGUCCGGGCCCA GAUCGCUAUCUGCGGAAUGGAGCCCAAGUCCU CCGACAAGACCCACACCUCCCCCACCCAGUCCC GCCCCCGAGCUGCUCGGGGGCAGCAGCGUGUU | 5' UTR 1 | 3' UTR 1 | 436 |

TABLE 7-continued

RNA Sequences

| Name | Sequence | 5' UTR | 3' UTR | SEQ ID NO: |
|---|---|---|---|---|
| | CCUGUUCCCUCCUAAGCCCAAGGACACGCUGU ACAUCACCAGGGAGCCCGAGGUCACCUGCGUG GUGGUGGACGUGUCCCAUGAGGACCCCGAGGU GAAGUUCAACUGGUACGUGGACGGCGUGGAG GUUCACAACGCUAAGACCAAGCCCCGCGAGGA ACAGUACAACAGCACCUAUCGGGUCGUGUCAG UUCUGACCGUCCUCCACCAGGACUGGCUGAAC GGCAAGGAGUACAAGUGCAAGGUGAGCAACA AAGCCCUCCCCGCCCCGAUCGAGAAGACCAUC AGCAAGGCCAAGGGCCAGCCCCGAGAGCCCCA GGUGUACACCCUUCCCCCCAGCAGGGACGAGC UCACAAAGAAUCAGGUGAGCCUGACCUGCCUG GUGAAGGGCUUCUACCCCUCCGACAUCGCGGU GGAAUGGGAGAGCAACGGCCAGCCGGAGAACA ACUAUAAGACAACACCCCCGUGCUGGACAGC GACGGCAGCUUCUUCCUCUACAGCAAGCUGAC CGUCGACAAGUCCAGAUGGCAGCAGGGCAACG UGUUCAGCUGCUCCGUGAUGCACGAAGCCCUG CACAAUCACUACACAGAAAAUCCCUGUCCCU GAGCCCCGGCAAGCGGAAGUCCACCUGGAGUA AGCGGAGUCUGAGCCAGGAGGACGCCCCCCAA ACCCCCCGACCCGUGGCCGAGAUCGUGCCCUC CUUCAUCAAUAAGGACACCGAGACUAUCAACA UGAUGAGCGAGUUCGUGGCCAACCUGCCCCAG GAGCUGAAGCUGACGCUGUCUGAGAUGCAGCC UGCCCUGCCCCAGCUGCAGCAGCACGUGCCAG UGCUGAAGGACAGCAGCCUGCUGUUCGAGGAG UUUAAGAAGCUAAUCAGAAACCGCCAGUCCGA GGCCGCCGACAGCAGCCCCUCCGAGCUCAAGU ACCUGGGCCUGGACACCCAUUCCCGCAAGAAG AGGCAGCUGUACUCGCCCUGGCCAACAAGUG CUGCACGUCGGGAUGUACCAAGAGAAGUCUGG CCAGGUUCUGC | | | |
| Construct 112 | AUGCCGCGGCUUUUCUUCUUCCACCUCCUCGG CGUGUGCCUACUCCUUAACCAAUUCUCCCGAG CCGUCGCCGACAGCUGGAUGGAGGAGGUGAUC AAACUCUGCGGCAGGGAGCUCGUGAGGGCCCA GAUAGCCAUCUGCGGCAUGGAACCCAAGUCCA GCGACAAGACCCACACCUCGCCCCCCCAGCCCC GCCCCCGAGCUGCUGGGCGGCUCAAGCGUGUU CCUGUUCCCGCCCAAGCCCAAGGACACCCUGU ACAUCACCAGAGAGCCGGAGGUCACCUGCGUG GUGGUGGACGUGUCACGAGGACCCCGAGGUC CAAGUUCAACUGGUACGUGGAUGGCGUGGAG GUGCACAAUGCAAAGACCAAGCCGAGAGAGGA ACAGUACAACUCGACGUACCGGGUCGUGAGCG UCCUGACCGUGCUGCACCAGGACUGGCUGAAU GGCAAGGAGUACAAGUGCAAAGUGUCGAAUA AGGCCCUGCCCGCCCCCAUCGAGAAGACCAUC UCCAAGGCCAAGGGCCAGCCCAGAGAACCGCA GGUAUACACCCUGCCCCCUUCCCGGGACGAGC UGACCAAGAACCAGGUGUCUCUCACGUGCCUG GUGAAGGGCUUCUACCCCAGCGACAUCGCCGU GGAGUGGGAGUCCAAUGGUCAGCCCGAGAACA ACUAUAAGACCACGCCGCCCGUGCUGGACUCA GACGGCUCCUUCUUCCUCUACAGCAAACUGAC GGUGGACAAGAGCCGGUGGCAGCAGGGCAACG UGUUCUCCUGCAGCGUCAUGCACGAGGCCCUG CACAACCACUACACUCAGAAGUCCCUGAGCCU GAGCCCCGGUGAAAGUCACCUGGAGCA AGCGGAGCCUGAGCCAAGAGGACGCCCCCCAA ACACCCCGCCCGUGGCCGAGAUAGUGCCUAG CUUCAUUAACAAGGACACCGAGACUAUCAACA UGAUGAGCGAGUUCGUGGCCAACCUGCCCCAG GAGCUGAAGCUGACCCUGUCCGAGAUGCAGCC GGCCCUGCCUCAGCUGCAGCAGCACGUGCCCG UGCUGAAGGACAGCAGCCUGCUGUUUGAGGA GUUCAAGAAGCUGAUCAGAAACCGCCAAAGCG AAGCCGCCGACUCCAGCCCUAGCGAGCUCAAG UACCUGGGCCUGGACACGCACAGCAGGAAGAA GAGGCAGCUGUACAGCGCCCUGGCCAACAAGU GCUGCCACGUCGGGUGCACCAAGAGGAGCCUG GCUAGGUUUUGC | 5' UTR 1 | 3' UTR 1 | 437 |
| Construct 113 | AUGCCCCGCCUGUUCUUCUUCCACCUCCUUGG CGUGUGCCUCCUCCUAAAUCAGUUCAGCCGCG CCGUGGCCGACAGCUGGAUGGAGGAGGUGAUC AAGCUCUGCGGGAGGGAGCUCGUGCGGGCCCA GAUCGCCAUCUGCGGCAUGGAGCCCAAGUCCA GCGACAAGACCCACACCUCGCCCCCCCAGCCCC GCCCCCGAGCUGCUGGGCGGGAGCAGCGUUUU CCUGUUUCCACCUAAGCCCAAGGACACUCUGU ACAUCACCAGAGAGCCCGAGGUCACAUGCGUG GUGGUGGACGUGUCACCAGGACCCCGAGGU GAAGUUCAACUGGUACGUCGAUGGCGUCGAG GUGCACAACGCCAAGACCAAGCCCAGGGAGGA GCAGUACAACAGCACCUACAGAGUGGUGUCCG UGCUGACCGUGCUGCACCAGGACUGGCUGAAU GGAAAGGAGUACAAGUGCAAGGUGAGCAACA AGGCCCUGCCCGCCGAUCGAGAAGACCAUA AGCAAGGCCAAGGGCCAACCGAGGGAGCCCCA GGUGUACACCCUGCCCCCCAGCAGAGAGC UGACCAAGAACCAGGUGAGCCUGACCUGCCUG GUCAAGGGCUUCUACCCCAGCGAUAUCGCCGU GGAAUGGGAGUCCAACGGACAGCCGGAGAACA ACUACAAGACCACCCCCCGUGCUCGACAGC GACGGGUCCUUCUUCCUGUACUCGAAGCUGAC CGUGGACAAGAGCCGCUGGCAGCAGGGCAACG UGUUCAGCUGCUCCGUGAUGCAUGAGGCCCUG CACAACCACUAUACGCAGAAGUCGCUCAGCCU GAGCCCCGGCAAGCGAAAGAGCACCUGGAGCA AGCGAAGCCUUAGCCAGGAGGAUGCCCCCCAG ACACCCCGGCCAGUGGCUGAGAUCGUCCCCAG CUUCAUCAACAAAGACACUGAGACAAUUAAUA UGAUGAGCGAGUUCGUGGCCCAAUCUGCCCCAG GAGCUCAAGCUGACCCUCAGCGAGAUGCAGCC CGCUCUGCCCCAGCUGCAACAGCACGUUCCCG UGCUGAAGGACAGCUCUCUGCUGUUCGAGGAG UUCAAGAAGCUGAUCAGGAACCGACAGAGCGA GGCGCCGACUCCAGCCCCUCGGAGCUCAAAU ACCUCGGCCUCGACACCCACAGCAGGAAGAAG AGGCAGCUGUACAGCGCCCUGGCCAACAAGUG CUGCCACGUCGGCUGCACCAAGAGGUCACUCG CCAGGUUCUGC | 5' UTR 1 | 3' UTR 1 | 438 |
| Construct 114 | AUGCCCAGGCUGUUCUUCUUCCACCUCCUCGG CGUGUGCCUCCUCCUCAAUCAGUUCAGCAGAG CCGUGGCCGAUAGCUGGAUGGAGGAGGUCAU UAAGCUCUGCGGCAGAGAGCUCGUGCGAGCCC AGAUCGCCAUCUGCGGCAUGGAGCCCAAGAGC AGCGAUAAGACCCAUACCUCUCCCCCCAGCCC CGCCCCCGAGCUGCUGGGCGGCUCCUCCGUGU UCCUGUUCCCUCCCAAGCCCAAGACACCCUG UACAUCACCAGAGAACCCGAGGUGACCUGUGU CGUGGUGGACGUGAGCCAGGAGGACCCGGAGG UGAAGUUCAAUUGGUACGUGGAUGGUGUCGA GGUGCACAACGCCAAGACGAAGCCCAGGGAGG AGCAGUAUAACAGCACUUAUCGCGUGGUCAGC GUGCUGACCGUCCUGCACCAAGACUGGCUGAA CGGUAAGGAGUAUAAGUGCAAGGUCAGCAAC AAAGCCCUGCCCGCUCCCAUCGAGAAGACGAU CAGCAAGGCCAAGGGCCAGCCCAGGGAGCCCC AGGUGUACACUCUGCCCCCCAGCAGAGACGAG CUGACCAAGAACCAGGUGAGCCUGACCUGCCU GGUGAAGGGUUCUACCCCAGCGACAUCGCCG UCGAGUGGGAGCAACGGCCAGCCCGAGAAC AACUAUAAGACCACACCCCCGGUGCUGGACUC CGACGGCAGCUUCUUCCUCUACAGCAAGCUCA CAGUUGAAGACAGAUGGCAGCAGGGCAA UGUGUUCAGCUGCAGCGUGAUGCACGAGGCCC UCCACAACCACUACACCCAGAAAUCCCUCAGC CUGAGCCCCGGCAAGCGGAGCCUGUCCCAGGAGGACGCCCCCC AAACGCCCCGGCCGGUGGCCGAGAUCGUCCCC AGCUUCAUCAACAAGGACACCGAGACUAUAAA CAUGAUGAGCGAGUUCGUGGCCAACCUGCCCC AGGAGCUCAAGCUGACCCUGAGCGAGAUGCAG | 5' UTR 1 | 3' UTR 1 | 439 |

TABLE 7-continued

RNA Sequences

| Name | Sequence | 5' UTR | 3' UTR | SEQ ID NO: |
|---|---|---|---|---|
| | CGUGCUGAAGGACAGCAGCCUCCUGUUCGAGG AGUUCAAGAAGCUGAUCAGGAACAGGCAGAG CGAGGCCGCCGACAGCAGCCCCAGCGAGCUGA AGUACCUGGGACUGGACACCCACAGCCGGAAG AAGCGCCAGCUCUACAGCGCCCUGGCCAACAA GUGCUGCCAUGUGGGGUGCACCAAGCGGUCCC UGGCCCGGUUCUGC | | | |
| Construct 115 | AUGCCCCGACUGUUCUUCUUCCACCUCCUCGG CGUGUGUCUCUUGCUUAAUCAGUUCAGCCGCG CCGUCGCCGACUCCUGGAUGGAGGAAGUGAUC AAGCUCUGUGGCCGGGAGCUCGUGCGGGCUCA GAUUGCAAUCUGCGGGAUGGAGCCCAAGUCGU CCGACAAGACCCACACCAGCCCGCCCUCGCCC GCCCCCGAGCUGCUUGGCGGCAGCAGCGUGUU CCUGUUUCCCCCAAGCCCAAGGACACCCUGU ACAUCACCCGGGAACCCGAGGUGACCUGCGUC GUGGUGGACGUGUCCCACGAGGACCCCGAGGU CAAGUUCAACUGGUACGUGGACGGCGUGGAG GUGCACAAUGCCAAGACCAAGCCCAGGGAGGA GCAAUACAACUCCACCUAUCGGGUGGUGAGCG UGCUGACCGUGCUGCACCAGGACUGGCUGAAC GGCAAGGAGUACAAGUGCAAGGUGUCAAACA AGGCGCUGCCCGCCCCCAUCGAGAAGACAAUC UCCAAGGCCAAGGGCCAGCCCCGGGAGCCCCA GGUGUACACCCUGCCCCCAGCCGGGACGAGC UGACCAAGAACCAGGUUAGCCUUACAUGCCUG GUCAAGGGCUUCUACCCCUCCGACAUCGCCGU GGAGUGGGAGUCCAACGGCCAGCCCGAGAACA ACUACAAGACCACACCCCCGUGCUGGACUCC GACGGCUCCUUCUUCCUUUACUCUAAGCUGAC CGUGGACAAGAGCCGCUGGCAACAGGGCAAUG UCUUCUCCUGCUCCGUGAUGCACGAGGCCCUG CACAAUCACUACACCCAGAAGUCCCUGAGCCU GUCCCCUGGAAAGCGGAAGUCCACCUGGAGCA AGAGGACCCUGUCCCAGGAGGAUGCCCUCAG ACCCCCAGGCCCGUGGCCGAGAUCGUGCCUUC AUUUAUUAACAAGGACACCGAGACGAUCAACA UGAUGUCCGAGUUUGUGGCCAACCUGCCCCAG GAGCUGAAGCUCACCCUCGCGAAAUGCAGC CGCCCUGCCCCAGCUGCAGCAGCACGUGCCCG UGCUGAAGGACUCCUCGCUGCUCUUUGAGGAG UUUAAGAAGCUGAUCCGGAACAGGCAGAGCG AGGCCGCAGAUUCCAGCCCCUCGGAGCUGAAG UACCUGGGCCUGGACACCCACAGCCGGAAGAA GCGUCAGCUGUACAGCGCCCUGGCCAACAAAU GUUGUCACGUGGGCUGCACUAAGAGGAGCCUG GCCAGAUUUUGU | 5' UTR 1 | 3' UTR 1 | 440 |
| Construct 116 | AUGCCCCGGUUAUUCUUCUUCCACUUGCUUGG CGUGUGCCUCCUCCUCAACCAGUUCAGCCGGG CCGUGGCCGACAGCUGGAUGGAGGAAGUGAUC AAGCUAUGCGGCCGGGAGCUCGUGCGGGCCCA GAUCGCCAUCUGCGGCAUGGAGCCCAAGAGCA GCGACAAGACCCACACCUCCCCACCAUCCCCU GCCCCCGAGCUGCUGGGAGGCAGCAGCGUGUU CCUGUUUCCCACCUAAGCCCAAGGACACCCUGU ACAUCACCCGGGAGCCCGAGGUGACCUGCGUG GUGGUGGACGUGAGCCACGAGGACCCCGAGGU GAAGUUCAACUGGUACGUGGACGGCGUGGAG GUGCACAACGCCAAGACCAAGCCCAGGGAGGA GCAGUACAACAGCACCUACCGGGUGGUGAGCG UGCUGACCGUGCUGCACCAGGACUGGCUGAAC GGCAAGGAGUACAAGUGCAAGGUGAGCAACA AGGCCCUGCCUGCCCCCAUCGAGAAGACCAUC AGCAAGGCCAAGGGCCAGCCUCGGGAGCCACA GGUGUACACCCUGCCUCCUUCCCGGGACGAGC UGACCAAGAACCAGGUGAGCCUGACCUGCCUG GUGAAGGGCUUCUACCCCUCCGACAUCGCCGU GGAGUGGGAGAGCAACGGUCAGCCUGAGAAC AACUACAAGACCACUCCACCCGUGCUGGACAG CGACGGCAGCUUCUUCCUGUACAGCAAGCUUA CCGUCGACAAGAGCCGGUGGCAGCAGGGCAAC GUGUUCAGCUGCAGCGUGAUGCACGAAGCCCU | 5' UTR 1 | 3' UTR 1 | 441 |
| | GCACAACCACUACACCCAGAAGAGUCUGUCAC UGAGCCCCGGCAAGAGGAAGUCCACCUGGUCA AAGCGGAGCCUGAGCCAGGAGGACGCUCCUCA AACCCCCCGGCCAGUGGCCGAGAUCGUGCCCA GCUUCAUCAAUAAGGACACAGAGACAAUCAAC AUGAUGAGCGAGUUCGUGGCCAACCUGCCCCA GGAGCUGAAGCUGACGCUCAGCGAGAUGCAGC CGCCCUCCCUCAACUACAGCAGCACGUGCCG GUGCUGAAGGACAGCAGCCUGCUGUUCGAGG GUUCAAGAAGCUGAUCCGGAACCGGCAGAGCG AGGCCGCUGACAGCUCCCCUUCCGAGCUUAAG UACCUGGGCCUGGACACCCACAGCCGGAAGAA GAGGCAGCUGUACAGUGCCCUGGCCAACAAGU GCUGCCACGUGGGCUGCACUAAGAGGUCACUG GCCCGGUUCUGC | | | |
| Construct 117 | AUGCCCCGGCUUUUCUUCUUCCACUUACUCGG CGUGUGCCUUCUCCUUAACCAGUUCAGCCGGG CCGUGGCCGACAGCUGGAUGGAGGAGGUGAUC AAGCUCUGCGGCCGGGAGCUCGUGCGGGCCCA GAUCGCCAUCUGCGGCAUGGAGCCCAAGAGCA GCGACAAGACCCACACCAGCCCCUCCUAGUCCU GCGCCCCGAGCUGCUUGGCGGCAGCAGCGUGUU CCUGUUCCCACCGAAGCCCAAGGACACCCUGU ACAUCACCCGGGAGCCCGAGGUGACCUGCGUG GUGGUGGACGUGAGCCACGAGGACCCGGAGGU GAAGUUCAACUGGUACGUGGACGGCGUGGAG GUGCACAACGCCAAGACCAAGCCCCGGGAGGA GCAGUACAACAGCACCUACCGGGUGGUGAGCG UGCUGACCGUGCUGCACCAGGACUGGCUGAAC GGCAAGGAGUACAAGUGCAAGGUGAGCAACA AGGCCCUGCCCCAAUCGAGAAGACCAUC AGCAAGGCCAAGGGCCAACCACGAGAGCCGCA GGUGUACACCCUGCCUCCUAGCCGGGACGAGC UGACCAAGAACCAGGUGAGCCUGACCUGCCUG GUGAAGGGCAGCGGCCGGAGCGACAUCGCCGU GGAGUGGGAGAGCAACGGUCAGCCUGAGAAC AACUACAAGACCACACCUCCCGUGCUGGACAG CGACGGCAGCUUCUUCCUGUACAGCAAGCUGA CAGUUGACAAGAGCCGGUGGCAGCAGGGCAAC GUGUUCAGCUGCAGCGUGAUGCACGAGGCCCU GCACAACCACUACACCCAGAAGAGUCUGUCUC UGUCCCCUGGCAAGAGGAAGUCCACCUGGUCC AAGAGGUCCCUGAGCCAGGAGGACGCCCCGCA GACCCCCCGGCCUGUGGCUGAGAUCGUGCCCA GCUUCAUCAAUAAGGAUACCGAGACAAUCAAC AUGAUGAGCGAGUUCGUGGCCAAUUUGCCACA GGAGCUGAAGCUGACCCUGAGCGAGAUGCAGC CGCCCUGCCGCAGCUCCAGCAACACGUGCCU GUCCUGAAGGACAGCAGCCUGCUGUUCGAGG GUUCAAGAAGCUGAUCCGGAACCGGCAGAGCG AGGCCGCCGACUCCUUCUCCGUCCGAACUGAAG UACCUGGGCCUGGACACCCACAGCCGGAAGAA GCGGCAGCUCUACUCCGCCCUGGCCAACAAGU GCUGCCACGUGGGAUGCACCAAGCGAAGCCUG GCCCGGUUCUGC | 5' UTR 1 | 3' UTR 1 | 442 |
| Construct 118 | AUGCCCCGGUUAUUCUUCUUCCACUUAUUAGG CGUGUGCUUACUCCUCAACCAGUUCAGCCGGG CCGUGGCCGACAGCUGGAUGGAGGAGGUGAUC AAGCUCUGCGGGAGCUCGUGCGGGCCCA GAUCGCCAUCUGCGGCAUGGAGCCCAAGAGCA GCGACAAGACCCACACCAGCCCCUCCUAGCCU GCCCCCGAGCUGCUGGGAGGCAGCAGCGUGUU CCUGUUCCCCACCUAAGCCCAAGGACACCCUGU ACAUCACCCGGGAGCCCGAGGUGACCUGCGUG GUGGUGGACGUGAGCCACGAGGACCCUGAGGU GAAGUUCAACUGGUACGUGGACGGCGUGGAG GUGCACAACAGCACCUACCGGGUGGUGAGCG UGCUGACCGUGCUGCACCAGGACUGGCUGAAC GGCAAGGAGUACAAGUGCAAGGUGAGCAACA AGGCCCUGCCAGCUCCUAUCGAGAAGACCAUC AGCAAGGCCAAGGGCCAGCCUAGAGAGCCUCA | 5' UTR 1 | 3' UTR 1 | 443 |

TABLE 7-continued

RNA Sequences

| Name | Sequence | 5' UTR | 3' UTR | SEQ ID NO: |
|---|---|---|---|---|
| | GGUGUACACCCUGCCGCCAAGCCGGGACGAGC UGACCAAGAACCAGGUGGCCCUGACCUGCUG GUGAAGGGCUUCUACCCCAGCGACAUCGCCGU GGAGUGGGAGAGCAACGGACAGCCUGAGAAC AACUACAAGACCACCCCACCCGUGCUGGACAG CGACGGCAGCUUCUUCUGUACAGCAAGCUCA CCGUGGACAAGAGCCGGUGGCAGCAGGGCAAC GUGUUCAGCUGCAGCGUGAUGCACGAAGCCCU GCACAACCACUACACCCAGAAGUCCCUAUCUC UGAGCCCCGGCAAGAGAAAGUCCACCUGGAGC AAGGAAGAAGUCUGAGCCAGGAGGACGCUCCACA GACCCCCCGGCCAGUGGCCGAGAUCGUGCCCA GCUUCAUCAACAAGGAUACAGAAACCAUUAAC AUGAUGAGCGAGUUCGUGGCCAACCUGCCCCA GGAGCUGAAGCUGACACUGAGCACGGAUGCAGC CCGCUCUGCCUCAGCUUCAGCAGCACGUGCCU GUGCUGAAGGACAGCAGCCUGCUGUUCGAGGA GUUCAAGAAGCUGAUCCGGAACCGGCAGAGCG AGGCCGCCGAUAGCGCCCCUAGUGAACUCAAG UACCUGGGCCUGGACACCCACAGCCGGAAGAA GCGGCAGCUGUAUAGCGCCCUGGCCAACAAGU GCUGCCACGUGGGCUGCACAAAGCGUAGCCUG GCCCGGUUCUGC | | | |
| Con-struct 119 | AUGCCCCGGCUUUUCUUCUUCCACCUCCUUGG CGUGUGCCUCCUCCUUAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCAAGUCCU CCGACAAGACCCACACCAGCCCGCCAAGCCCA GCCCCCGAGCUCCUCGGCGGCUCCUCCGUCUU CCUCUUCCCUCCAAAGCCCAAGGACACCCUCU ACAUCACCCGCGAGCCCGAGGUCACCUGCGUC GUCGUCGACGUCUCCCACGAGGACCCAGAGGU UAAGUUCAACUGGUACGUCGACGGCGUCGAGG UCCACAACGCCAAGACCAAGCCCCGCGAGGAG CAGUACAACUCCACCUACCGCGUCGUCUCCGU CCUCACCGUCCUCCACCAGGACUGGCUCAACG GCAAGGAGUACAAGUGCAAGGUGUCCAACAA GGCCCUGCCUGCCCCUAUCGAGAAGACCAUCU CCAAGGCCAAGGGCCAGCCUCGGGAGCCUCAG GUCUACACCCUGCCACCUAGUCGCGACGAGCU CACCAAGAACCAGGUGCCCUCACCUGCCUCG UCAAGGGCUUCUACCCUAGCGACAUCGCCGUC GAGUGGGAGUCCAACGGCCAGCCAGAGAACAA CUACAAGACCACCCCUCCCGUCCUCGACUCCG ACGGCUCCUUCUUCCUGUACUCCAAGCUCACU GUGGACAAGUCCCGCUGGCAGCAGGGCAACGU CUUCUCCUGCUCCGUCAUGCACGAAGCUCUCC ACAACCACUACACCCAGAAGUCCCUCUCACUG AGCCCCGGCAAGCGCAAGUCCACCUGGUCCAA GCGGCAGCUGCUAGGAGGACGCCCCCCAGA CACCACGCCCUGUCGCCGAGAUCGUCCCCCUCC UUCAUCAAUAAGGACACGGAGACGAUCAACAU GAUGUCCGAGUUCGUCGCCAACCUGCCACAGG AGCUGAAGCUGACCCUCUCCGAGAUGCAGCCC GCCCUGCCGCAGCUCCAGCAGCACGUGCCAGU GCUGAAGGACUCCUCCCUCCUCUUCGAGGAGU UCAAGAAGCUCAUCCGCAACCGCCAGUCCGAG GCCGCUGACUCAAGCCCUUCAGAGCUUAAGUA CCUCGGCCUCGACACCCACUCCCGCAAGAAGC GCCAGCUGUACAGCGCCCUCGCCAACAAGUGC UGCCACGUCGGCUGCACAAAGCGAAGCCUGGC CCGCUUCUGC | 5' UTR 1 | 3' UTR 1 | 444 |
| Con-struct 120 | AUGCCCAGGCUGUUCUUCUUCCACCUCCUUGG CGUGUGCCUCUUUACUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCAAGUCCU CCGACAAGACCCACACCUCUCCACCGAGCCCA GCCCCCGAGCUCCUCGGCGGCUCCUCCGUCUU CCUCUUCCCUCCUAAGCCCAAGGACACCCUCU ACAUCACCCGCGAGCCCGAGGUCACCUGCGUC | 5' UTR 1 | 3' UTR 1 | 445 |
| | GUCGUCGACGUCUCCCACGAGGACCCAGAGGU GAAGUUCAACUGGUACGUCGACGGCGUCGAGG UCCACAACGCCAAGACCAAGCCCCGCGAGGAG CAGUACAACUCCACCUACCGCGUCGUCUCCGU CCUCACCGUCCUCCACCAGGACUGGCUCAACG GCAAGGAGUACAAGUGCAAGGUGUCCAACAA GGCCCUGCCUGCCCCUAUCGAGAAGACCAUCU CCAAGGCCAAGGGCCAGCCACGGGAGCCACAG GUCUACACACUGCCUCCGAGCCGCGACGAGCU CACCAAGAACCAGGUGUCCCUCACCUGCCUCG UCAAGGGCUUCUACCCUAGCGACAUCGCCGUC GAGUGGGAGUCCAACGGCCAGCCGGAGAACAA CUACAAGACCACCCCGCCCGUCCUCGACUCCG ACGGCUCCUUCUUCCUGUACUCCAAGCUGACA GUGGACAAGUCCCGCUGGCAGCAGGGCAACGU CUUCUCCUGCUCCGUCAUGCACGAGGCUCUGC ACAACCACUACACCCAGAAGUCCCUCAGCCUG UCUCCCGGCAAGCGCAAGUCCACCUGGUCCAA GAGGAGCUUGUCCCAGGAGGACGCCCCCAGA CUCCACGCCCUGUCGCCGAGAUCGUCCCCUCC UUCAUCAAUAAGGACACAGAGACGAUCAACAU GAUGUCCGAGUUCGUCGCCAACCUUCCUCAGG AGCUGAAGCUGACCCUCUCCGAGAUGCAGCCC GCCCUGCCGCAGCUCCAGCAGCACGUGCCAGU GCUCAAGGACUCCUCCCUCCUCUUCGAGGAGU UCAAGAAGCUCAUCCGCAACCGCCAGUCCGAG GCCGCCGACAGUAGCCCUUCCGAGCUCAAGUA CCUCGGCCUCGACACCCACUCCCGCAAGAAGC GCCAGCUGUAUCAGCCCCUCGCCAACAAGUGC UGCCACGUCGGCUGCACGAAGCGGAGCCUGGC CCGCUUCUGC | | | |
| Con-struct 121 | AUGCCCAGGUUGUUCUUCUUCCACCUUUUGGG CGUGUGCCUCCUUCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCAAGUCCU CCGACAAGACCCACACCUCUCCUCCGAGUCCA GCACCCGAGCUCCUCGGCGGCUCCUCCGUCUU CCUCUUCCCUCCUAAGCCCAAGGACACCCUCU ACAUCACCCGCGAGCCCGAGGUCACCUGCGUC GUCGUCGACGUCUCCCACGAGGACCCAGAGGU CAAGUUCAACUGGUACGUCGACGGCGUCGAGG UCCACAACGCCAAGACCAAGCCCCGCGAGGAG CAGUACAACUCCACCUACCGCGUCGUCUCCGU CCUCACCGUCCUCCACCAGGACUGGCUCAACG GCAAGGAGUACAAGUGCAAGGUGUCCAACAA GGCCCUUCCUGCCCCUAUCGAGAAGACCAUCU CCAAGGCCAAGGGCCAGCCACGGGAGCCUCAG GUCUACACCCUGCCUCCUAGCCGCGACGAGCU CACCAAGAACCAGGUGUCCCUCACCUGCCUCG UCAAGGGCUUCUACCCUAGCGACAUCGCCGUC GAGUGGGAGUCCAACGGUCAGCCUGAGAACAA CUACAAGACCACCCCACCCGUCCUCGACUCCG ACGGCUCCUUCUUCCUUUACUCCAAGCUGACC GUGGACAAGUCCCGCUGGCAGCAGGGCAACGU CUUCUCCUGCUCCGUCAUGCACGAGGCCCUGC ACAACCACUACACCCAGAAGUCCCUCUCUCUG AGCCCCGGCAAGCGCAAGUCCACCUGGUCCAA GAGAUCUCUCAGCCAGGAGGACGCCCCCAGA CCCCACGCCCAGUCGCCGAGAUCGUCCCCUCC UUCAUCAACAAGGAUACCGAAACAUCAACAU GAUGUCCGAGUUCGUCGCCAACCUGCCACAGG AGCUGAAGCUCACACUCUCCGAGAUGCAGCCC GCCCUCCACAGCUCCAGCAGCACGUGCCAGU GCUGAAGGACUCCUCCCUCCUCUUCGAGGAGU UCAAGAAGCUCAUCCGCAACCGCCAGUCCGAG GCCGCCGACUCCAGUCCUAGCGAACUGAAGUA CCUCGGCCUCGACACCCACUCCCGCAAGAAGC GCCAGCUGUACAGCGCCCUCGCCAACAAGUGC UGCCACGUCGGCUGCACAAAGCGCAGCCUGGC CCGCUUCUGC | 5' UTR 1 | 3' UTR 1 | 446 |

TABLE 7-continued

RNA Sequences

| Name | Sequence | 5' UTR | 3' UTR | SEQ ID NO: |
|---|---|---|---|---|
| Construct 122 | AUGCCCCGGCUUUCUUCUUCCACCUACUCGG CGUGUGCCUUCUCCUUAACCAGUUCAGCCGGG CCGUGGCCGACAGCUGGAUGGAGGAGGUGAUC AAGCUCUGCGGCCGGGAGCUUGUGCGGGCCCA GAUCGCCAUCUGCGGCAUGGAGCCCAAGAGCA GCGACAAGACCCACACCUCUCCGCCGAGCCCA GCUCCCGAGCUCCUGGGCGGCAGCAGCGUGUU CCUGUUCCACCAAAGCCCAAGGACACCCUGU ACAUCACCCGGGAGCCCGAGGUGACCUGCGUG GUGGUGGACGUGAGCCACGAGGACCCGGAGGU GAAGUUCAACUGGUACGUGGACGGCGUGGAG GUGCACAACGCCAAGACCAAGCCCCGGGAGGA GCAGUACAACAGCACCUACCGGGUGGUGAGCG UGCUGACCGUGCUGCACCAGGACUGGCUGAAC GGCAAGGAGUACAAGUGCAAGGUGAGCAACA AGGCCCUGCCUGCCCCUAUCGAGAAGACCAUC AGCAAGGCCAAGGGCCAGCCGCGGGAGCCUCA GGUGUACACCCUGCCUCCUUCUCGGGACGAGC UGACCAAGAACCAGGUGAGCCUGACCUGCCUG GUGAAGGGCUUCUACCCCAGCGACAUCGCCGU GGAGUGGGAGAGCAACGGCCAGCCUGAGAACA ACUACAAGACCACCCCUCCCGUGCUGGACAGC GACGGCAGCUUCUUCCUGUACAGCAAGUUAAC CGUGGACAAGAGCCGGUGGCAGCAGGGCAACG UGUUCAGCUGCAGCGUGAUGCACGAGGCACUG CACAACCACUACACCCAGAAGAGUCUGAGUCU CAGCCCCGGCAAGCGGAAGCGGAAGCCCCCAG CUUCAUCAACAAGGAUACCGAGACAAUAAACA UGAUGAGCGAGUUCGUGGCCAACCUGCCCCAG GAGCUGAAGCUGACUCUGAGCGAGAUGCAGCC CGCCCUGCCACAAUUGCAGCAGCACGUGCCUG UGCUGAAGGACAGCAGCCUGCUGUUCGAGGAG UUCAAGAAGCUGAUCCGGAACCGGCAGAGCGA GGCCGCCGACAGUAGCCCAAGCGAACUUAAGU ACCUGGGCCUGGACACCCACAGCCGGAAGAAG CGGCAGCUGUACUCCGCCCUGGCCAACAAGUG CUGCCACGUGGGCUGUACCAAGAGGAGCCUGG CCCGGUUCUGC | 5' UTR 1 | 3' UTR 1 | 447 |
| Construct 123 | AUGCCCCGGCUUUCUUCUUCCACUUGCUCGG CGUGUGCCUACUUCUCAACCAGUUCAGCCGGG CCGUGGCCGACAGCUGGAUGGAGGAGGUGAUC AAGCUCUGCGGCCGGGAGCUCGUGCGGGCCCA GAUCGCCAUCUGCGGCAUGGAGCCCAAGAGCA GCGACAAGACCCACACCUCUCCUCCUAGCCCU GCCCCCGAGCUCCUGGGCGGCAGCAGCGUGUU CCUGUUCCCACCUAAGCCCAAGGACACCCUGU ACAUCACCCGGGAGCCCGAGGUGACCUGCGUG GUGGUGGACGUGAGCCACGAGGACCCAGAAGU GAAGUUCAACUGGUACGUGGACGGCGUGGAG GUGCACAACGCCAAGACCAAGCCCCGGGAGGA GCAGUACAACAGCACCUACCGGGUGGUGAGCG UGCUGACCGUGCUGCACCAGGACUGGCUGAAC GGCAAGGAGUACAAGUGCAAGGUGAGCAACA AGGCCCUGCCUGCCCCUAUCGAGAAGACCAUC AGCAAGGCCAAGGGACAGCCAAGAGAGCCUCA GGUGUACACCCUGCCACCUAGCCGGGACGAGC UGACCAAGAACCAGGUGAGCCUGACCUGCCUG GUGAAGGGCUUCUACCCCAGCGACAUCGCCGU GGAGUGGGAGAGCAACGGCCAGCCUGAGAACA ACUACAAGACCACCCCACCCGUGCUGGACAGC GACGGCAGCUUCUUCCUGUACAGCAAGCUCAC AGUGGACAAGAGCCGGUGGCAGCAAGGCAACG UGUUCAGCUGCAGCGUGAUGCACGAGGCCCUC CACAACCACUACACACAGAAGUCCCUGAGCCU UAGCCCCGGCAAGAGAAAGAGCACCUGGUCCA AGAGUCUGUCCCAGCAAGCGCCCCCCAGA ACCCCCGGCCAGUGGCUGAGAUCGUGCCCAG CUUCAUCAACAAGGAUACAGAGACUAUCAACA UGAUGAGCGAGUUCGUGGCCAACCUGCCCCAG GAGCUGAAGCUGACCCUGAGCGAGAUGCAGCC CGCCCUUCCACAACUGCAGCAGCACGUGCCAG | 5' UTR 1 | 3' UTR 1 | 448 |
| | UGCUGAAGGACAGCAGCCUGCUGUUCGAGGAG UUCAAGAAGCUGAUCCGGAACCGGCAGAGCGA GGCCGCCGAUAGCAGCCCAAGCGAACUCAAGU ACCUGGGCCUGGACACCCACAGCCGGAAGAAG CGGCAGCUGUACAGUGCCCUGGCCAACAAGUG CUGCCACGUGGGAUGCACCAAGCGGAGCCUGG CCCGGUUCUGC | | | |
| Construct 124 | AUGCCCCGGCUUUUCUUCUUCCACCUCUUGGG CGUGUGCCUCUUGCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCAAGUCCU CCGACAAGACCCACACCAGCCCACCUUCACCG GCCCCCGAGCUCCUCGGCGGCUCCUCCGUCUU CCUCUUCCCACCUAAGCCCAAGGACACCCUCU ACAUCACCCGCGAGCCCGAGGUCACCUGCGUC GUCGUCGACGUCUCCCACGAGGACCCAGAGGU GAAGUUCAACUGGUACGUCGACGGCGUCGAGG UCCACAACGCCAAGACCAAGCCCCGCGAGGAG CAGUACAACUCCACCUACCGCGUCGUCUCCGU CCUCACCGUCCUCCACCAGGACUGGCUCAACG GCAAGGAGUACAAGUGCAAGGUGUCCAACAA GGCCCUCCCAGCCCCAAUCGAGAAGACCAUCU CCAAGGCCAAGGGCCAGCCUCGAGAGCCACAG GUCUACACCCUGCCACCUUCCCGCGACGAGCU CACCAAGAACCAGGUGUCCCUCACCUGCCUCG UCAAGGGCUUCUACCCCUCCGACAUCGCCGUC GAGUGGGAGUCCAACGGACAACAGAGAACAA CUACAAGACCACCCCGCCCGUCCUCGACUCCG ACGGCUCCUUCUUCCUGUACUCCAAGCUGACC GUGGACAAGUCCCGCUGGCAGCAGGGCAACGU CUUCUCCUGCUCCGUCAUGCACGAGGCCCUGC ACAACCACUACACCCAGAAGUCCCUCUCACUC UCCCCCGGCAAGCGCAAGUCCACCUGGUCCAA GAGAUCCUGUCCCAGCAAGAGCCCCCCCAGA CACCACGUCCUGUCGCCGAGAUCGUCCCCUCC UUCAUCAACAAGGAUACAGAAACCAUCAACAU GAUGUCCGAGUUCGUCGCCAACCUUCCUCAGG AGCUGAAGCUCACCCUCUCCGAGAUGCAGCCC GCCUUGCCACAGCUCCAGCAGCACGUUCCUGU GCUCAAGGACUCCUCCCUCCUCUUCGAGGAGU UCAAGAAGCUCAUCCGCAACCGCCAGUCCGAG GCCGCCGACUCCAGCCCCUAGCGAGCUAAAGUA CCUCGGCCUCGACACCCACUCCCGCAAGAAGC GCCAGCUCUAUUCCGCCCUCGCCAACAAGUGC UGCCACGUCGGCUGCACAAAGAGAAGCCUCGC CCGCUUCUGC | 5' UTR 1 | 3' UTR 1 | 449 |
| Construct 125 | AUGCCCAGACUCUUCUUCUUCCACCUUCUCGG CGUGUGCCUCCUUCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCAAGUCCU CCGACAAGACCCACACCAGCCCACCUAGCCCA GCCCCCGAGCUCCUCGGCGGCUCCUCCGUCUU CCUCUUCCCCUCCGAAGCCCAAGGACACCCUCU ACAUCACCCGCGAGCCCGAGGUCACCUGCGUC GUCGUCGACGUCUCCCACGAGGACCCAGAGGU GAAGUUCAACUGGUACGUCGACGGCGUCGAGG UCCACAACGCCAAGACCAAGCCCCGCGAGGAG CAGUACAACUCCACCUACCGCGUCGUCUCCGU CCUCACCGUCCUCCACCAGGACUGGCUCAACG GCAAGGAGUACAAGUGCAAGGUGUCCAACAA GGCCCUGCCCAAUCGAGAAGACCAUCU CCAAGGCCAAGGGCCAGCCUAGAGAGCCUCAG GUCUACACCCUGCCUCCAAGCCGCGACGAGCU CACCAAGAACCAGGUUCCCUCACCUGCCUCG UCAAGGGCUUCUACCCCUUCGACAUCGCCGUC GAGUGGGAGUCCAACGGCAGCCAGAGAACAA CUACAAGACCACCCCUCCCGUCCUCGACUCCG ACGGCUCCUUCUUCCUGUACUCCAAGCUGACC GUGGACAAGUCCCGCUGGCAGCAGGGCAACGU CUUCUCCUGCUCCGUCAUGCACGAGGCCCUCC | 5' UTR 1 | 3' UTR 1 | 450 |

TABLE 7-continued

RNA Sequences

| Name | Sequence | 5' UTR | 3' UTR | SEQ ID NO: |
|---|---|---|---|---|
| | ACAACCACUACACCCAGAAGUCCCUCUCCCUC UCACCCGGCAAGCGCAAGUCCACCUGGUCCAA GCGGUCCCUGUCCCAGGAGGACGCCCCCAGA CCCCUCGGCCGGUCGCCGAGAUCGUCCCCUCC UUCAUCAACAAGGAUACCGAGACGAUCAACAU GAUGUCCGAGUUCGUCGCCAAUCUCCCACAGG AGCUGAAGCUUACCCUCUCGAGAUGCAGCCC GCCCUGCCGCAGCUCCAGCAGCACGUGCCUGU CCUCAAGGACUCCUCCCUCCUCUUCGAGGAGU UCAAGAAGCUCAUCCGCAACCGCCAGUCCGAG GCCGCCGAUUCCUCUCCUUCCGAGCUCAAGUA CCUCGCCCUCGACACCCACUCCCGCAAGAAGC GCCAGCUGUAUUCCGCCCUCGCCAACAAGUGC UGCCACGUCGGCUGCACGAAGAGGAGCCUGGC CCGCUUCGC | | | |
| Construct 126 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUGAUC AAGCUGUGCGGCCGGGAGCUGGUGCGGGCCCA GAUCGCCAUCUGCGGCAUGGAGCCCAAGAGCA GCGACAAGACCCACACCAGCCCCCCCAGCCCC GCCCCCGAGCUGCUGGGCGGCAGCAGCGUGUU CCUGUUCCCCCCCAAGCCCAAGGACACCCUGU ACAUCACCCGGGAGCCCGAGGUGACCUGCGUG GUGGUGGACGUGAGCCACGAGGACCCCGAGGU GAAGUUCAACUGGUACGUGGACGGCGUGGAG GUGCACAACGCCAAGACCAAGCCCCGGGAGGA GCAGUACAACAGCACCUACCGGGUGGUGAGCG UGCUGACCGUGCUGCACCAGGACUGGCUGAAC GGCAAGGAGUACAAGUGCAAGGUGAGCAACA AGGCCCUGCCCGCCCCCAUCGAGAAGACCAUC AGCAAGGCCAAGGGCCAGCCCCGGGAGCCCCA GGUGUACACCCUGCCCCCCAGCCGGGACGAGC UGACCAAGAACCAGGUGAGCCUGACCUGCCUG GUGAAGGGCUUCUACCCCAGCGACAUCGCCGU GGAGUGGGAGAGCAACGGCCAGCCCGAGAACA ACUACAAGACCACCCCCCCCGUGCUGGACAGC GACGGCAGCUUCUUCCUGUACAGCAAGCUGAC CGUGGACAAGAGCCGGUGGCAGCAGGGCAACG UGUUCAGCUGCAGCGUGAUGCACGAGGCCCUG CACAACCACUACACCCAGAAGAGCCUGAGCCU GAGCCCCGGCAAGCGGAAGAGCACCUGGAGCA AGCGGAGCCUGAGCCAGGAGGCGCCCCCCAG ACCCCCCGGCCCGUGGCCGAGAUCGUGCCCAG CUUCAUCAACAAGGACACCGAGACCAUCAACA UGAUGAGCGAGUUCGUGGCCAACCUGCCCCAG GAGCUGAAGCUGACCCUGAGCGAGAUGCAGCC CGCCCUGCCCAGCUGCAGCAGCACGUGCCCG UGCUGAAGGACAGCAGCCUGCUGUUCGAGGAG UUCAAGAAGCUGAUCCGGAACCGGCAGAGCGA GGCCGCCGACAGCAGCGCCGAGCUGAAGU ACCUGGGCCUGGACACCCACAGCCGGAAGAAG CGGCAGCUGUACAGCGCCCUGGCCAACAAGUG CUGCCACGUGGGCUGCACCAAGCGGAGCCUGG CCCGGUUCUGC | 5' UTR 1 | 3' UTR 1 | 451 |
| Construct 127 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUGAUC AAGCUGUGCGGGAGGGAGCUGGUGCGGGCGG AGAUCGCGAUCUGCGGGAUGGAGCCGAAGAGC AGCGACAAGACGCACACGAGCCCGCCGAGCCC GGCGCCGGAGCUGCUGGGGGGGAGCAGCGUGU UCCUGUUCCCGCCGAAGCCGAAGGACACGCUG UACAUCACGAGGGAGCCGGAGGUGACGUGCGU GGUGGUGGACGUGAGCCACGAGGACCCGGAGG UGAAGUUCAACUGGUACGUGGACGGGGUGGA GGUGCACAACGCCAAGACGAAGCCGCGGGAGG AGCAGUACAACAGCACGUACAGGGUGGUGAGC GUGCUGACGGUGCUGCACCAGGACUGGCUGAA CGGGAAGGAGUACAAGUGCAAGGUGAGCAAC AAGGCGCUGCCGGCGCCGAUCGAGAAGACGAU CAGCAAGGCGAAGGGGCAGCCGAGGGAGCCGC | 5' UTR 1 | 3' UTR 1 | 452 |
| | AGGUGUACACGCUGCCGCCGAGCAGGGACGAG CUGACGAAGAACCAGGUGAGCCUGACGUGCCU GGUGAAGGGGUUCUACCCGAGCGACAUCGCGG UGGAGUGGGAGAGCAACGGGCAGCCGGAGAA CAACUACAAGACGACGCCGCCGGUGCUGGACA GCGACGGGAGCUUCUUCCUGUACAGCAAGCUG ACGGUGGACAAGAGCAGGUGGCAGCAGGGGA ACGUGUUCAGCUGCAGCGUGAUGCACGAGGCG CUGCACAACCACUACACGCAGAAGAGCCUGAG CCUGAGCCCGGGGAAGAGGAAGAGCACGUGGA GCAAGAGGAGCCUGAGCCAGGAGGCGCCGCCG CAGACGCCGAGGCCGGUGGCGGAGAUCGUGCC GAGCUUCAUCAACAAGGACACGGAGACGAUCA ACAUGAUGAGCGAGUUCGUGGCGAACCUGCCG CAGGAGCUGAAGCUGACGCUGAGCGAGAUGCA GCCGGCGCUGCCGCAGCUGCAGCAGCACGUGC CGGUGCUGAAGGACAGCAGCCUGCUGUUCGAG GAGUUCAAGAAGCUGAUCAGGAACAGGCAGA GCGAGGCGGCGGACAGCAGCCCGAGCUG AAGUACCUGGGCCUGGACACGCACAGCAGGAA GAAGAGGCAGCUGUACAGCGCGCUGGCGAACA AGUGCUGCCACGUGGGGUGCACGAAGAGGAGC CUGGCGAGGUUCUGC | | | |
| Construct 128 | AUGCCCCGGCUGUUCUUCUUCCACCUGCUGGG CGUGUGCCUGCUGCUGAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGGAGCCCAAGUCCU CCGACAAGACCCACACCUCCCCCCCCUCCCCCG CCCCCGAGCUCCUCGGCGGCUCCUCCGUCUUC CUCUUCCCCCCCAAGCCCAAGGACACCCUCUA CAUCACCCGCGAGCCCGAGGUCACCUGCGUCG UCGUCGACGUCUCCCACGAGGACCCCGAGGUC AAGUUCAACUGGUACGUCGACGGCGUCGAGGU CCACAACGCCAAGACCAAGCCCCGCGAGGAGC AGUACAACUCCACCUACCGCGUCGUCUCCGUC CUCACCGUCCUCCACCAGGACUGGCUCAACGG CAAGGAGUACAAGUGCAAGGUCUCCAACAAGG CCCUCCCCGCCCCCAUCGAGAAGACCAUCUCC AAGGCCAAGGGCCAGCCCCGCGAGCCCCAGGU CUACACCCUCCCCCCCUCCCGCGACGAGCUCA CCAAGAACCAGGUCUCCCUCACCUGCCUCGUC AAGGGCUUCUACCCCUCCGACAUCGCCGUCGA GUGGGAGUCCAACGGCCAGCCCGAGAACAACU ACAAGACCACCCCCCCCGUCCUCGACUCCGAC GGCUCCUUCUUCCUCUACUCCAAGCUCACCGU CGACAAGUCCCGCUGGCAGCAGGGCAACGUCU UCUCCUGCUCCGUCAUGCACGAGGCCCUCCAC AACCACUACACCCAGAAGUCCCUCUCCCUCUC CCCCGGCAAGCGCAAGUCCACCUGGUCCAAGC GCUCCCUCUCCCAGGAGGCGCCCCCAGACC CCCGCCCCGUCGCCGAGAUCGUCCCCUCCUU CAUCAACAAGGACACCGAGACCAUCAACAUGA UGUCCGAGUUCGUCGCCAACCUCCCCCAGGAG CUCAAGCUCACCCUCUCCGAGAUGCAGCCCGC CCUCCCCCAGCUCCAGCAGCACGUCCCCGUCC UCAAGGACUCCUCCCUCCUCUUCGAGGAGUUC AAGAAGCUCAUCCGCAACCGCCAGUCCGAGGC CGCCGACUCCUCCCCCUCCGAGCUCAAGUACC UCGGCCUCGACACCCACUCCCGCAAGAAGCGG CAGCUCUACUCCGCCCUCGCCAACAAGUGCUG CCACGUCGGCUGCACCAAGCGCUCCCUCGCCC GCUUCUGC | 5' UTR 1 | 3' UTR 1 | 453 |
| Construct 129 | AUGCCUCGCCUGUUUUUUUUCCACCUGCUAGG AGUCUGUUUACUACUGAACCAAUUUCCAGAG CAGUCGCGGACUCAUGGAUGGAGGAAGUUAU UAAAAUUAUGCGGCCGCGAAUUAGUCUGAGAU CAGAUUGCCAUUUGCGGCAUGAGCACCUGGAGC GGCAGCACAGACUCCGGCUCUGAUACCAGCUC CGGCAACAGCGGCGAUGGCAAUUCCGGCCAAC UCUACAGUGCAUUGGCUAAUAAAUGUUGCCA UGUUGGUUGUACCAAAAGAUCUCUUGCUAGA | 5' UTR 1 | 3' UTR 2 | 454 |

TABLE 7-continued

RNA Sequences

| Name | Sequence | 5' UTR | 3' UTR | SEQ ID NO: |
|---|---|---|---|---|
| | UUUUGCGGCAGCACAGACUCCGGCUCUGAUAC CAGCUCCGGCAACAGCGGCGAUGGCAAUUCCG GCGGCAGCUCCGGAGGAGGCUCUGGCUCUAGC UCCGGCUCUAGCGGCAGCGGCGGCUCCGGCGG CAGCACAGACUCCGGCUCUGAUACCAGCUCCG GCAACAGCGGCGAUGGCAAUUCCGGCGGCAGC UCCGGAGGAGGCUCUGGCUCUAGCUCCGGCUC UAGCGGCAGCGGCGGCUCCGGCGAGCCCAAGA GCAGCGACAAGACCCACACCAGCCCCCCCAGC CCCGCCCCCGAGCUGCUGGGCGGCAGCAGCGU GUUCCUGUUCCCCCCCAAGCCCCAAGGACACCC UGUACAUCACCAGGGAGCCCGAGGUGACCUGC GUGGUGGUGGACGUGAGCCACGAGGACCCCGA GGUGAAGUUCAACUGGUACGUGGACGGCGUG GAGGUGCACAACGCCAAGACAAGCCCAGGGA GGAGCAGUACAACAGCACCUACAGGGUGGUGA GCGUGCUGACCGUGCUGCACCAGGACUGGCUG AACGGCAAGGAGUACAAGUGCAAGGUGAGCA ACAAGGCCCUGCCCGCCCCCAUCGAGAAGACC AUCAGCAAGGCCAAGGGCCAGCCCAGGGAGCC CCAGGUGUACACCCUGCCCCCAGCAGGGACG AGCUGACCAAGAACCAGGUGAGCCUGACCUGC CUGGUGAAGGGCUUCUACCCCAGCGACAUCGC CGUGGAGUGGGAGAGCAACGGCCAGCCCGAGA ACAACUACAAGACCACCCCCCCCGUGCUGGAC AGCGACGGCAGCUUCUUCCUGUACAGCAAGCU GACCGUGGACAAGAGCAGGUGGCAGCAGGGCA ACGUGUUCAGCUGCAGCGUGAUGCACGAGGCC CUGCACAACCACUACACCCAGAAGAGCCUGAG CCUGAGCCCCGGCAAGAGGAAG | | | |
| Construct 130 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC GGCAGCACAGACUCCGGCUCUGAUACCAGCUC CGGCAACAGCGGCGAUGGCAAUUCCGGCAAC UCUACAGUGCAUUGGCUAAUAAAUGUUGCCA UGUUGGUUGUACCAAAAGAUCUCUUGCUAGA UUUUGCGAGCCCAAGAGCAGCGACAAGACCCA CACCAGCCCCCCCAGCCCCGCCCCGAGCUGCU GGGCGGCAGCAGCGUGUUCCUGUUCCCCCCA AGCCCCAAGGACACCCUGUACAUCACCAGGG AGCCCGAGGUGACCUGCGUGGUGGUGGACGU GAGCCACGAGGACCCCGAGGUGAAGUUCAACU GGUACGUGGACGGCGUGGAGGUGCACAACGCC AAGACAAGCCCAGGGAGGAGCAGUACAACAGC ACCUACAGGGUGGUGAGCGUGCUGACCGUGCU GCACCAGGACUGGCUGAACGGCAAGGAGUACA AGUGCAAGGUGAGCAACAAGGCCCUGCCCGCC CCCAUCGAGAAGACCAUCAGCAAGGCCAAGGG CCAGCCCAGGGAGCCCCAGGUGUACACCCUGCC CCCCAGCAGGGACGAGCUGACCAAGAACCAGGU GAGCCUGACCUGCCUGGUGAAGGGCUUCUACC CCAGCGACAUCGCCGUGGAGUGGGAGAGCAAC GGCCAGCCCGAGAACAACUACAAGACCACCCC CCCCGUGCUGGACAGCGACGGCAGCUUCUUCC UGUACAGCAAGCUGACCGUGGACAAGAGCAGG UGGCAGCAGGGCAACGUGUUCAGCUGCAGCGU GAUGCACGAGGCCCUGCACAACCACUACACCC AGAAGAGCCUGAGCCUGAGCCCCGGCAAGAGG AAG | 5' UTR 1 | 3' UTR 2 | 455 |
| Construct 131 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC GGCAGCACAGACUCCGGCUCUGAUACCAGCUC CGGCAACAGCGGCGAUGGCAAUUCCGGCAAC UCUACAGUGCAUUGGCUAAUAAAUGUUGCCA UGUUGGUUGUACCAAAAGAUCUCUUGCUAGA UUUUGCGGCAGCACAGACUCCGGCUCUGAUAC | 5' UTR 1 | 3' UTR 2 | 456 |
| | CAGCUCCGGCAACAGCGGCGAUGGCAAUUCCG GCGAGCCCAAGAGCAGCGACAAGACCCACACC AGCCCCCCCAGCCCCGCCCCCGAGCUGCUGGG CGGCAGCAGCGUGUUCCUGUUCCCCCCCAAGC CCAAGGACACCCUGUACAUCACCAGGGAGCCC GAGGUGACCUGCGUGGUGGUGGACGUGAGCC ACGAGGACCCCGAGGUGAAGUUCAACUGGUAC GUGGACGGCGUGGAGGUGCACAACGCCAAGAC CAAGCCCAGGGAGGAGCAGUACAACAGCACCU ACAGGGUGGUGAGCGUGCUGACCGUGCUGCAC CAGGACUGGCUGAACGGCAAGGAGUACAAGU GCAAGGUGAGCAACAAGGCCCUGCCCGCCCCC AUCGAGAAGACCAUCAGCAAGGCCAAGGGCCA GCCCAGGGAGCCCCAGGUGUACACCCUGCCCC CCAGCAGGGACGAGCUGACCAAGAACCAGGUG AGCCUGACCUGCCUGGUGAAGGGCUUCUACCC CAGCGACAUCGCCGUGGAGUGGGAGAGCAACG GCCAGCCCGAGAACAACUACAAGACCACCCCC CCCGUGCUGGACAGCGACGGCAGCUUCUUCCU GUACAGCAAGCUGACCGUGGACAAGAGCAGGU GGCAGCAGGGCAACGUGUUCAGCUGCAGCGUG AUGCACGAGGCCCUGCACAACCACUACACCCA GAAGAGCCUGAGCCUGAGCCCCGGCAAGAGGA AG | | | |
| Construct 132 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGCUCUGAGCCAGGAAGAUGCUCCCAU GACACCUAGACCAGUGGCAGAAAAUUGUGCCAU CCUUCAUCAACAAAGAUACAGAAACCAUAAAU AUGAUGUCAGAAUUUGUUGCUAAUUUGCCAC AGGAGCUGAAGUUAAACCCUGUCUGAGAUGCA GCCAGCAUUACCACAGUGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAUACUCAAGGACAUGAAUACUCAUUCUCGA AAAAAAGAGACAACUCUACAGUGCAUUGGCUA AUAAAUGUUGCCAUGUUGGUUGUACCAAAAG AUCUCUUGCUAGAUUUUGCGGCAGCACAGACU CCGGCUCUGAUACCAGCUCCGGCAACAGCGGC GAUGGCAAUUCCGGCGAGCCCAAGAGCAGCGA CAAGACCCACACCAGCCCCCCCAGCCCCGCCCC CGAGCUGCUGGGCGGCAGCAGCGUGUUCCUGU UCCCCCCCAAGCCCAAGGACACCCUGUACAUC ACCAGGGAGCCCGAGGUGACCUGCGUGGUGGU GGACGUGAGCCACGAGGACCCCGAGGUGAAGU UCAACUGGUACGUGGACGGCGUGGAGGUGCAC AACGCCAAGACCAAGCCCAGGGAGGAGCAGUA CAACAGCACCUACAGGGUGGUGAGCGUGCUGA CCGUGCUGCACCAGGACUGGCUGAACGGCAAG GAGUACAAGUGCAAGGUGAGCAACAAGGCCCU GCCCGCCCCCAUCGAGAAGACCAUCAGCAAGG CCAAGGGCCAGCCCAGGGAGCCCCAGGUGUAC ACCCUGCCCCCAGCAGGGACGAGCUGACCAA GAACCAGGUGAGCCUGACCUGCCUGGUGAAGG GCUUCUACCCCAGCGACAUCGCCGUGGAGUGG GAGAGCAACAACUACAA GACCACCCCCCCGUGCUGGACAGCGACGGCA GCUUCUUCCUGUACAGCAAGCUGACCGUGGAC AAGAGCAGGUGGCAGCAGGGCAACGUGUUCA GCUGCAGCGUGAUGCACGAGGCCCUGCACAAC CACUACACCCAGAAGAGCCUGAGCCUGAGCCCC GGCAAGAGGAAG | 5' UTR 1 | 3' UTR 2 | 457 |
| Construct 133 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGUCUCUGAGCCAGGAAGAUGCUCCUCA | 5' UTR 1 | 3' UTR 2 | 458 |

TABLE 7-continued

RNA Sequences

| Name | Sequence | 5' UTR | 3' UTR | SEQ ID NO: |
|---|---|---|---|---|
| | GACACCUAGACCAGUGGCAGAAAUUGUGCCAU CCUUCAUCAACAAAGAUACAGAAACCAUAAAU AUGAUGUCAGAAUUUGUUGCUAAUUUGCCAC AGGAGCUGAAGUUAACCCUGUCUGAGAUGCA GCCAGCAUUACCACAGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAAUACUUAGGCUUGGAUACUCAUUCUCGA AAAAAGAGAGAGCCCAAGAGCAGCGACAAGAC CCACACCAGCCCCCCCAGCCCCGCCCCCGAGCU GCUGGGCGGCAGCAGCGUGUUCCUGUUCCCCC CCAAGCCCAAGGACACCCUGUACAUCACCAGG GAGCCCGAGGUGACCUGCGUGGUGGUGGACGU GAGCCACGAGGACCCCGAGGUGAAGUUCAACU GGUACGUGGACGGCGUGGAGGUGCACAACGCC AAGACCAAGCCCAGGGAGGAGCAGUACAACAG CACCUACAGGGUGGUGAGCGUGCUGACCGUGC UGCACCAGGACUGGCUGAACGGCAAGGAGUAC AAGUGCAAGGUGAGCAACAAGGCCCUGCCCGC CCCCAUCGAGAAGACCAUCAGCAAGGCCAAGG GCCAGCCCAGGGAGCCCCAGGUGUACACCAAG CCCCCCAGCAGGGACGAGCUGACCAAGAACCA GGUGAGCCUGUCCUGCCUGGUGAAGGGCUUCU ACCCCAGCGACAUCGCCGUGGAGUGGGAGAGC AACGGCCAGCCCGAGAACAACUACAAGACCAC CGUCCCCGUGCUGGACAGCGACGGCAGCUUCC GCCUGGCCAGCUAUCUGACCGUGGACAAGAGC AGGUGGCAGCAGGGCAACGUGUUCAGCUGCAG CGUGAUGCACGAGGCCCUGCACAACCACUACA CCCAGAAGAGCCUGAGCCUGAGCCCCGGCAAG AGGAAGGGCAGCACAGACUCCGGCUCUGAUAC CAGCUCCGGCAACAGCGGCGAUGGCAAUUCCG GCCAACUCUACAGUGCAUUGGCUAAUAAAUGU UGCCAUGUUGGUUGUACCAAAAGAUCUCUUGC UAGAUUUUGC | | | |
| Construct 134 | AUGCCUCGCCUGUUUUUUUUCCACCUGCUAGG AGUCUGUUUACUACUGAACCAAUUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGUCUCUGAGCCAGGAAGAUGCUCCUCA GACACCUAGACCAGUGGCAGAAAUUGUGCCAU CCUUCAUCAACAAAGAUACAGAAACCAUAAAU AUGAUGUCAGAAUUUGUUGCUAAUUUGCCAC AGGAGCUGAAGUUAACCCUGUCUGAGAUGCA GCCAGCAUUACCACAGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAAUACUUAGGCUUGGAUACUCAUUCUCGA AAAAAGAGAGAGGUGCAGCUGCUGGAGAGCG GCGGCGGCCUGGUGCAGCCCGGCGGCAGCCUG AGGCUGAGCUGCGCCGCCAGCGGCUUCACCUU CAGCAGCUACGCCAUGAGCUGGGUGCGCCAGG CCCCCGGCAAGGGCCUGGAGUGGGUGAGCGGC AUCAGCGGCAGCGGCGGCAGCACCUACUACGC CGACAGCGUGAAGGGCAGGUUCACCAUCAGCA GGGACAACAGCAAGAACACCCUGUACCUGCAG AUGAACUCGCUGAGGGCCGAGGACACCGCCGU GUACUACUGCACCAAGGACCCCCCCAGGUACC ACUACACCGGCUGGCCGUGAGGGGCCAGGGC ACCACCGUGACCGUGAGCAGCGGCAGCACAGA CUCCGGCUCUGAUACCAGCUCCGGCAACAGCG GCGAUGGCAAUUCCGGCCAACUCUACAGUGCA UUGGCUAAUAAAUGUUGCCAUGUUGGUUGUA CCAAAAGAUCUCUUGCUAGAUUUUGC | 5' UTR 1 | 3' UTR 2 | 459 |
| Construct 135 | AUGCCUCGCCUGUUUUUUUUCCACCUGCUAGG AGUCUGUUUACUACUGAACCAAUUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC | 5' UTR 1 | 3' UTR 2 | 460 |
| | AAAAGGUCUCUGAGCCAGGAAGAUGCUCCUCA GACACCUAGACCAGUGGCAGAAAUUGUGCCAU CCUUCAUCAACAAAGAUACAGAAACCAUAAAU AUGAUGUCAGAAUUUGUUGCUAAUUUGCCAC AGGAGCUGAAGUUAACCCUGUCUGAGAUGCA GCCAGCAUUAAACCACAGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAAUACUUAGGCUUGGAUACUCAUUCUCGA AAAAAGAGAGAGCCCAAGAGCAGCGACAAGAC CCACACCAGCCCCCCCAGCCCCGCCCCCGAGCU GCUGGGCGGCAGCAGCGUGUUCCUGUUCCCCC CCAAGCCCAAGGACACCCUGUACAUCACCAGG GAGCCCGAGGUGACCUGCGUGGUGGUGGACGU GAGCCACGAGGACCCCGAGGUGAAGUUCAACU GGUACGUGGACGGCGUGGAGGUGCACAACGCC AAGACCAAGCCCAGGGAGGAGCAGUACAACAG CACCUACAGGGUGGUGAGCGUGCUGACCGUGC UGCACCAGGACUGGCUGAACGGCAAGGAGUAC AAGUGCAAGGUGAGCAACAAGGCCCUGCCCGC CCCCAUCGAGAAGACCAUCAGCAAGGCCAAGG GCCAGCCCAGGGAGCCCCAGGUGUACACCCUG CCCCCCAGCAGGGACGAGCUGACCAAGAACCA GGUGAGCCUGACCUGCCUGGUGAAGGGCUUCU ACCCCAGCGACAUCGCCGUGGAGUGGGAGAGC AACGGCCAGCCCGAGAACAACUACAAGACCAC CCCCCCCGUGCUGGACAGCGACGGCAGCUUCU UCCUGUACAGCAAGCUGACCGUGGACAAGAGC AGGUGGCAGCAGGGCAACGUGUUCAGCUGCAG CGUGAUGCACGAGGCCCUGCACAACCACUACA CCCAGAAGAGCCUGAGCCUGAGCCCCGGCAAG AGGAAGGGCAGCACAGACUCCGGCUCUGAUAC CAGCUCCGGCAACAGCGGCGAUGGCAAUUCCG GCCAACUCUACAGUGCAUUGGCUAAUAAAUGU UGCCAUGUUGGUUGUACCAAAAGAUCUCUUGC UAGAUUUUGC | | | |
| Construct 136 | AUGCCUCGCCUGUUUUUUUUCCACCUGCUAGG AGUCUGUUUACUACUGAACCAAUUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGUCUCUGAGCCAGGAAGAUGCUCCUCA GACACCUAGACCAGUGGCAGAAAUUGUGCCAU CCUUCAUCAACAAAGAUACAGAAACCAUAAAU AUGAUGUCAGAAUUUGUUGCUAAUUUGCCAC AGGAGCUGAAGUUAACCCUGUCUGAGAUGCA GCCAGCAUUACCACAGCUACAACAACAUGUAC CUGUAUUAAAAGAUUCCAGUCUUCUCUUUGA AGAAUUUAAGAAACUUAUUCGCAAUAGACAA AGUGAAGCCGCAGACAGCAGUCCUUCAGAAUU AAAAAUACUUAGGCUUGGAUACUCAUUCUCGA AAAAAGAGACAACUCUACAGUGCAUUGGCUA AUAAAUGUUGCCAUGUUGGUUGUACCAAAAG AUCUCUUGCUAGAUUUUGGCGGCAGCACAGACU CCGGCUCUGAUACCAGCUCCGGCAACAGCGGC GAUGGCAAUUCCGGCGAGCCCAAGAGCAGCGA CAAGACCCACACCAGCCCCCCCAGCCCCGCCCC CGAGCUGCUGGGCGGCAGCAGCGUGUUCCGU UCCCCCCCAAGCCCAAGGACACCCUGUACAUC ACCAGGGAGCCCGAGGUGACCUGCGUGGUGGU GGACGUGAGCCACGAGGACCCCGAGGUGAAGU UCAACUGGUACGUGGACGGCGUGGAGGUGCAC AACGCCAAGACCAAGCCCAGGGAGGAGCAGUA CAACAGCACCUACAGGGUGGUGAGCGUGCUGA CCGUGCUGCACCAGGACUGGCUGAACGGCAAG GAGUACAAGUGCAAGGUGAGCAACAAGGCCCU GCCCGCCCCCAUCGAGAAGACCAUCAGCAAGG CCAAGGGCCAGCCCAGGGAGCCCCAGGUGUAC ACCAAGCCCCCCAGCAGGGACGAGCUGACCAA GAACCAGGUGAGCCUGUCCUGCCUGGUGAAGG GCUUCUACCCCAGCGACAUCGCCGUGGAGUGG GAGAGCAACGGCCAGCCCGAGAACAACUACAA | 5' UTR 1 | 3' UTR 2 | 461 |

TABLE 7-continued

RNA Sequences

| Name | Sequence | 5' UTR | 3' UTR | SEQ ID NO: |
|---|---|---|---|---|
| | GACCACCGUCCCCGUGCUGGACAGCGACGGCA GCUUCCGCCUGGCCAGCUAUCUGACCGUGGAC AAGAGCAGGUGGCAGCAGGGCAACGUGUUCA GCUGCAGCGUGAUGCACGAGGCCCUGCACAAC CACUACACCCAGAAGAGCCUGAGCCUGAGCCC CGGCAAGAGGAAG | | | |
| Construct 137 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGUCUCUGAGCCAGGAAGAUGCUCCUCA GACACCUAGACCAGUGGCAGAAAUUGUGCCAU CCUUCAUCAACAAAGAUACAGAAACCAUAAAU AUGAUGUCAGAAUUUGUUGCUAAUUUGCCAC AGGAGCUGAAGUUAACCCUGUCUGAGAUGCA GCCAGCAUUACCACAGCUACAACAACAUGUAC CUGUAUUAAAAGACCUAUCAGUCUUUCUCUUUGA AGAAUUUAAGAAACUUAUUCGCAAUAGACAA AGUGAGCCGCAGACAGCAGUCCUUCAGAAUU AAAAUACUUAGGCUUGGAUACUCAUUCUCGA AAAAAGAGACAACUCUACAGUGCAUUGGCUA AUAAAUGUUGCCAUGUUGGUUGUACCAAAAG AUCUCUUGCUAGAUUUUGCGGCAGCACAGACU CCGGCUCUGAUACCAGCUCCGGCAACAGCGGC GAUGGCAAUUCCGGCGAGCGCUGCUGGA GAGCGGCGGCGGCCUGGUGCAGCCCGGCGGCA GCCUGAGGCUGAGCUGCGCCGCCAGCGGCUUC ACCUUCAGCAGCUACGCCAUGAGCUGGGUGAG GCAGGCCCCGGCAAGGGCUGGAGUGGUGA GCGCCAUCAGCGGCAGCGGCGGCAGCACCUAC UACGCCGACAGCGUGAAGGGCAGGUUCACCAU CAGCAGGGACAACAGCAAGAACACCCUGUACC UGCAGAUGAACAGCCUGAGGGCCGAGGACACC GCCGUGUACUACUGCACCAAGGACCCCCCCAG GUACCACUACACCGGCCUGGCCGUGAGGGGCC AGGGCACCACCGUGACCGUGAGCAGC | 5' UTR 1 | 3' UTR 2 | 462 |
| Construct 138 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC GGCAGCACAGACUCCGGCUCUGAUACCAGCUC CGGCAACAGCGGCGAUGGCAAUUCCGGCGAGC CCAAGAGCAGCGACAAGACCCACACCAGCCCC CCAGCCCCGCCCCGAGCUGCUGGGGCCCAG CAGCGUGUUCCUGUUCCCCCCAAGCCCAAGG ACACCCUGUACAUCACCAGGGAGCCCGAGGUG ACCUGCGUGGUGGUGGACGUGAGCCACGAGGA CCCCGAGGUGAAGUUCAACUGGUACGUGGACG GCGUGGAGGUGCACAACGCCAAGACCAAGCCC AGGGAGGAGCAGUACAACAGCACCUACAGGGU GGUGAGCGUGCUGACCGUGCUGCACCAGGACU GGCUGAACGGCAAGGAGUACAAGUGUAAGGU GAGCAACAAGGCCCUGCCCGCCCCCAUCGAGA AGACCAUCAGCAAGGCCAAGGGCCAGCCCAGG GAGCCCCAGGUGUACACCAAGCCCCCCAGCAG GGACGAGCUGACCAAGAACCAGGUGAGCCUGU CCUGCUGGGUGAAGGGCUUCUACCCCAGCGAC AUCGCCGUGGAGUGGGAGAGCAACGGCCAGCC CGAGAACAACUACAAGACCACCGUCCCCGUGC UGGACAGCGACGGCAGCUUCCGCCUGGCCAGC UAUCUGACCGUGGACAAGAGCAGGUGGCAGCA GGGCAACGUGUUCAGCUGCAGCGUGAUGCACG AGGCCCUGCACAACCACUACACCCAGAAGAGC CUGAGCCUGAGCCCCGGCAAGAGGAAGAAAAA GUCUCAGGAGAUGCUCCUCAGACACCUAGACC AGUGGCAGAAAUUGUGCCAUCCUUC AUCAACAAAGAUACAGAAACCAUAAAUAUGA UGUCAGAAUUUGUUGCUAAUUUGCCACAGGA GCUGAAGUUAACCCUGUCUGAGAUGCAGCCAG CAUUACCACAGCUACAACAACAUGUACCUGUA | 5' UTR 1 | 3' UTR 2 | 463 |
| | UUAAAAGAUUCCAGUCUUCUCUUUGAAGAAU UUAAGAAACUUAUUCGCAAUAGACAAAGUGA AGCCGCAGACAGCAGUCCUUCAGAAUUAAAAU ACUUAGGCUUGGAUACUCAUUCUCGAAAAAAA GAGACAACUCUACAGUGCAUUGGCUAAUAAAA UGUUGCCAUGUUGGUUGUACCAAAAGAUCUC UUGCUAGAUUUUGC | | | |
| Construct 139 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC GGCAGCACAGACUCCGGCUCUGAUACCAGCUC CGGCAACAGCGGCGAUGGCAAUUCCGGCCAAC UCUACAGUGCAUUGGCUAAUAAAUGUUGCCA UGUUGGUUGUACCAAAAGAUCUCUUGCUAGA UUUUGCGGCAGCACAGACUCCGGCUCUGAUAC CAGCUCCGGCAACAGCGGCGAUGGCAAUUCCG GCGAGGUGCAGCUGUGGAGAGCGGCGGCGGC CUGGUGCAGCCCGGCGGCAGCCUGAGGCUGAG CUGCGCCGCCAGCGGCUUCACCUUCAGCAGCU ACGCCAUGAGCUGGGUGAGGCAGGCCCCCGGC AAGGGCCUGGAGUGGGUGAGCGCCAUCAGCGG CAGCGGCGGCAGCACCUACUACGCCGACAGCG UGAAGGGCAGGUUCACCAUCAGCAGGGACAAC AGCAAGAACACCCUGUACCUGCAGAUGAACAG CCUGAGGGCCGAGGACACCGCCGUGUACUACU GCACCAAGGACCCCCCAGGUACCACUACACC GGCCUGGCCGUGAGGGGCCAGGGCACCACCGU GACCGUGAGCAGC | 5' UTR 1 | 3' UTR 2 | 464 |
| Construct 140 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC GGCAGCACAGACUCCGGCUCUGAUACCAGCUC CGGCAACAGCGGCGAUGGCAAUUCCGGCCAAC UCUACAGUGCAUUGGCUAAUAAAUGUUGCCA UGUUGGUUGUACCAAAAGAUCUCUUGCUAGA UUUUGCGGCAGCACAGACUCCGGCUCUGAUAC CAGCUCCGGCAACAGCGGCGAUGGCAAUUCCG GCGAGCCCAAGAGCAGCGACAAGACCCACACC AGCCCCCCAGCCCCGCCCCGAGCUGCUGGG CGGCAGCAGCGUGUUCCUGUUCCCCCCAAGC CCAAGGACACCCUGUACAUCACCAGGGAGCCC GAGGUGACCUGCGUGGUGGUGGACGUGAGCC ACGAGGACCCCGAGGUGAAGUUCAACUGGUAC GUGGACGGCGUGGAGGUGCACAACGCCAAGAC CAAGCCCAGGGAGGAGCAGUACAACAGCACCU ACAGGGUGGUGAGCGUGCUGACCGUGCUGCAC CAGGACUGGCUGAACGGCAAGGAGUACAAGU GCAAGGUGAGCAACAAGGCCCUGCCCGCCCCC AUCGAGAAGACCAUCAGCAAGGCCAAGGGCCA GCCCAGGGAGCCCCAGGUGUACACCAAGCCCC CCAGCAGGGACGAGCUGACCAAGAACCAGGUG AGCCUGUCCUGCUGGUGAAGGGCUUCUACCC CAGCGACAUCGCCGUGGAGUGGGAGAGCAACG GCCAGCCCGAGAACAACUACAAGACCACCGUC CCCGUGCUGGACAGCGACGGCAGCUUCCGCCU GGCCAGCUAUCUGACCGUGGACAAGAGCAGGU GGCAGCAGGGCAACGUGUUCAGCUGCAGCGUG AUGCACGAGGCCCUGCACAACCACUACACCCA GAAGAGCCUGAGCCUGAGCCCCGGCAAGAGGA AG | 5' UTR 1 | 3' UTR 2 | 465 |
| Construct 141 | AUGCCCCGGCUGUUCUUCUUCCACCUGCUGGG CGUGUGCCUGCUGAACCAGAUUGCAGGUGGG CCGUGGCCGACAGCUGGAUGGAGGAGGUGAUC AAGCUGUGCGGCAGGGAGCUGGUGAGGGCGC AGAUCGCCAUCUGCGGCAUGAGCACCUGGAGC AAGAGGGCCUGAGCCAGGAGGACGCCCCGCA AACCCCCCGGCCGGUCGCGGAGAUAGUGCCCA | 5' UTR 1 | 3' UTR 1 | 466 |

TABLE 7-continued

RNA Sequences

| Name | Sequence | 5' UTR | 3' UTR | SEQ ID NO: |
|---|---|---|---|---|
| | GCUUCAUAAACAAGGACACCGAGACCAUCAAU AUGAUGAGCGAGUUCGUGGCCAACCUGCCCA GGAGCUGAAGCUGACGCUGAGCGAGAUGCAGC CGGCCCUGCCGCAGCUGCAGCAGCACGUGCCC GUGCUGAAGGACAGCAGCCUCCUGUUCGAGGA GUUCAAGAAGCUGAUCAGGAACCGGCAGAGCG AGGCCGCCGACUCCAGCCCCAGCGAGCUGAAG UACCUGGGCCUGGACACCCAUAGCAGGAAGAA GCGCCAGCUGUACAGCGCCCUGGCUAACAAGU GCUGCCACGUGGGCUGCACCAAGAGGAGCCUG GCCCGGUUCUGC | | | |
| Construct 142 | AUGCCCCGCCUCUUCUUCUUCCACCUCCUCGG CGUGUGCCUCCUACUCAACCAGUUUAGCAGGG CCGUGGCCGAUAGCUGGAUGGAGGAGGUGAU CAAGCUCUGCGGCAGAGAGCUCGUGCGGGCC AGAUCGCCAUCUGCGGCAUGAGCACCUGGAGC AAGAGGAGCCUGACCCAGGAGGACGCCCCACA AACCCCGCGCCCCGUGGCCGAGAUCGUGCCCA GCUUCAUCAACAAGGACACCGAAACCAUCAAC AUGAUGAGCGAGUUUGUCGCCAACCUGCCCA GGAGCUCAAGCUGACCCUGAGCGAGAUGCAGC CCGCCCUGCCUGCAGCUGCAGCAGCACGUGCCA GUGCUGAAAGACUCCAGCCUGCUCUUUGAAGA GUUCAAGAAGCUGAUCAGGAACAGACAGAGC GAGGCCGCUGACAGCAGCCCCUCAGAGCUGAA GUACCUGGGCUGGAUACCCAUAGCCGCAAGA AGCGGCAGCUGUACUCCGCCCUCGCCAACAAG UGCUGCCACGUGGGCUGCACCAAGCGGAGCCU CGCCCGAUUCUGUGGCGGCGGAGGGUCCGGCG GCGGCGGCAGCGGUGGAGGCGGGAGCGACAUC CAGAUGACCCAGAGCCCCAGCAGCCUGUCCGC CAGUGUGGGCGAUAGAGUCACCAUCACGUGCA GGGCCUCCAGGCCCAUCGGCACCAUGCUGAGC UGGUACCAGCAGAAGCCCGGCAAGGCGCCCAA GCUGCUGAUCCUGGCCUUCAGCAGGCUGCAGU CCGGGGUGCCCAGCCGGUUCUCCGGCUCGGGC AGCGGCACCGACUUUACCCUGACCAUCAGCAG CCUGCAGCCUGAGGACUUCGCCACCUACUACU GCGCCCAGGCCGGCACCCACCCCACCACGUUC GGUCAGGGCACUAAGGUGGAGAUCAAGCGG | 5' UTR 1 | 3' UTR 1 | 467 |
| Construct 143 | AUGCCCCGCCUCUUCUUCUUCCACCUCCUCGG CGUGUGCCUCCUACUCAACCAGUUUAGCAGGG CCGUGGCCGAUAGCUGGAUGGAGGAGGUGAU CAAGCUCUGCGGCAGAGAGCUCGUGCGGGCC AGAUCGCCAUCUGCGGCAUGAGCACCUGGAGC AAGAGGAGCCUGACCCAGGAGGACGCCCCACA AACCCCGCGCCCCGUGGCCGAGAUCGUGCCCA GCUUCAUCAACAAGGACACCGAAACCAUCAAC AUGAUGAGCGAGUUUGUCGCCAACCUGCCCA GGAGCUCAAGCUGACCCUGAGCGAGAUGCAGC CCGCCCUGCCUCAGCUGCAGCAGCACGUGCCA GUGCUGAAAGACUCCAGCCUGCUCUUUGAAGA GUUCAAGAAGCUGAUCAGGAACAGACAGAGC GAGGCCGCUGACAGCAGCCCCUCAGAGCUGAA GUACCUGGGCUGGAUACCCAUAGCCGCAAGA AGCGGCAGCUGUACUCCGCCCUCGCCAACAAG UGCUGCCACGUGGGCUGCACCAAGCGGAGCCU CGCCCGAUUCUGUGGCGGCGGAGGGUCCGGCG GCGGCGGCAGCGGUGGAGGCGGGAGCGACAUC CAGAUGACCCAGAGCCCCAGCAGCCUGUCCGC CAGUGUGGGCGAUAGAGUCACCAUCACGUGCA GGGCCUCCAGGCCCAUCGGCACCAUGCUGAGC UGGUACCAGCAGAAGCCCGGCAAGGCGCCCAA GCUGCUGAUCCUGGCCUUCAGCAGGCUGCAGU CCGGGGUGCCCAGCCGGUUCUCCGGCUCGGGC AGCGGCACCGACUUUACCCUGACCAUCAGCAG CCUGCAGCCUGAGGACUUCGCCACCUACUACU GCGCCCAGGCCGGCACCCACCCCACCACGUUC GGUCAGGGCACUAAGGUGGAGAUCAAGCGG | 5' UTR 1 | 3' UTR 1 | 468 |
| Construct 144 | AUGCCCCGGCUGUUCUUCUUCCACCUACUCGG CGUCUGCCUCCUCCUAAAACCAGUUUUCCCGCG | 5' UTR 1 | 3' UTR 1 | 469 |
| | CCGUGGCCGACUCCUGGAUGGAGGAGGUGAUC AAGCUCUGCGGCAGAGAGCUCGUGAGGGCCCA GAUCGCGAUUUGCGGCAUGUCCACCUGGAGCA AGAGGAGCCUCAGCCAGGAGGACGCGCCCCAA ACCCCGAGGCCCGUGGCCGAGAUCGUGCCGAG CUUUAUCAACAAGGACACCGAAACCAUCAACA UGAUGUCCGAGUUUGUGGCCUAAAUCUGCCCCAG GAGCUCAAGCUCACACUGUCCGAGAUGCAGCC CGCCCUGCCCAACUGCAGCAGCACGUCCCCG UGCUCAAGGACAGCAGCCUCCUCUUCGAGGAA UUCAAGAAGCUCAUCCGCCAACCGGCAGAGCGA GGCCGCCGACAGCAGCCCCUCAGAGCUGAAGU ACCUGGGCCUCGACACCCACAGCCGGAAGAAG AGGCAGCUGUACUCCGCCCUGGCCAACAAAUG CUGCCAUGUGGGCUGCACCAAAAGGAGGCCUGG CCCGGUUUUGCGGAGGUGGUGGGAGCGGCGG UGGCGGUUCAGGCGGCGGCGGUUCCGACAUCC AGAUGACCCAGAGCCCCAGCAGCCUGUCCGCU UCCGUGGCCGACCGUGUGACCAUCACCUGCCG CGCCAGCCGACCCAUCGGCACCAUGCUGUCCU GGUACCAGCAGAAGCGGGGAAAGGCCCCAAAG CUGCUGAUUCUGGCCUUUAGCCGGCUGCAGAG CGGGGUGCCCAGCAGAUUCAGCGGCUCGGGA GCGGGACCGACUUUACGCUGACCAUCAGCUCC CUGCAGCCCGAGGAUUUCGCAACGUACUACUG UGCCCAGGCCGGCACCCACCCCACUACUUUCG GCCAGGGCACCAAGGUGGAGAUCAAGCGU | | | |
| Construct 145 | AUGCCCAGGCUGUUCUUCUUCCACCUCCUCGG CGUGUGUCUCCUCCUCAACCAGUUCAGCAGAG CCGUCGCCGAUUCUUGGAUGGAGGAGGUGAUC AAGUUGUGCGGCCGGAGCUCGUGAGGGCUCA GAUCGCCAUCUGCGGCAUGUCAACCUGGAGCA AGCGGUCGCUGAGCCAGGAGGACGCCCCUCAG ACCCCGAGGCCCGUGGCCGAGAUCGUGCCUAG CUUCAUCAACAAGGACACCGAAACCAUCAACA UGAUGAGCGAGUUUGUGGCGAAUCUGCCCCAG GAGCUGAAGCUCACCCUCAGCGAGAUGCAGCC CGCCCUGCCCAGCUGCAGCAGCACGUGCCCG UGCUGAAGGACUGCAGCCUCUGUUCGAGGAG UUUAAGAAGCUGAUCCGGAACAGGCAGAGCG AGGCCGCCGACAGCAGCCCCUCUGAACUGAAG UAUCUCGGGCUGGACACCCACAGCCGGAAGAA GCGCCAGCUGUAUUCCGCCCUGGCCAACAAAU GCUGCCACGUGGGCUGCACCAAACGGAGCCUG GCCCGGUUCUGUGGCGGCGGCGGCUCCGGCGG CGGUGGGUCUGGAGGCGGCGGCUCGGAUAUCC AGAUGACCCAGAGCCCCAGCAGCCUGUCCGCU UCCGUGGGCGACAGGGUGACCAUCACCUGCCG GGCCUCUAGGCCCAUCGGGACCAUGCUCAGCU GGUACCAGCAGAAAACCAGGCAAGGCCCCUAAG CUGCUGAUCCUGGCCUUCAGCCGCCUGCAGAG CGGCGUCCCCUCCAGGUUCAGCGGCCAGCGGUA GCGGAACGGACUUCACCCUCACCAUUAGCUCC CUCCAGCCCGAGGACUUCGCCACCUACUACUG UGCACAGGCCGGUACCCACCCCACGACCUUCG GCCAGGGCACAAAGGUGGAGAUCAAGCGG | 5' UTR 1 | 3' UTR 1 | 470 |
| Construct 146 | AUGCCUAGGCUGUUCUUCUUCCACCUCCUCGG CGUGUGUCUCCUCCUCAACCAGUUCAGCGGG CCGUGGCCGACUCCUGGAUGGAGGAGGUGAUC AAGCUCUGCGGCAGAGAGCUCGUCCGAGCCCA GAUAGCCAUCUGCGGCAUGAGCACCUGGAGCA AGAGGAGCCUGAGUCAGGAGGACGCCCCUCAG ACACCCCGGCCCGUGGCUGAGAUCGUGCCAG CUUCAUUAACAAAGACACCGAAACCAUCAACA UGAUGUCCGAGUUCGUGGCCAAUCUGCCACAG GAGCUCAAGCUGACCCUGAGCGAGAUGCAGCC CGCCCUCCCAGCUGCAGCAGCACGUGCCAGU GCUGAAGGACAGCAGCCUGCUCUUUGAGGAG UUCAAGAAGCUGAUCCGCAACGACAGAGCGA GGCUGCCGAUAGCAGCCCUUCCGAACUCAAAU ACCUGGGCUGGACACACAGCCGGAAGAAG CGGCAGCUGUACAGCGCCCUGGCUAACAAGUG | 5' UTR 1 | 3' UTR 1 | 471 |

TABLE 7-continued

RNA Sequences

| Name | Sequence | 5' UTR | 3' UTR | SEQ ID NO: |
|---|---|---|---|---|
| | UUGCCACGUAGGGUGCACCAAACGCAGCCUGG CCAGAUUCUGCGGCGGCGGCGGCUCCGGCGGA GGCGGAUCAGGCGGCGGCGGCAGCGAUAUCCA GAUGACUCAGAGCCCCAGCUCCCUGAGCGCCU CCGUUGGGACCGGGUGACCAUCACCUGCAGA GCGAGCCGCCCAUCGGCACCAUGCUCUCCUG GUACCAACAGAAGCCAGGCAAGGCCCCGAAGC UGCUGAUUCUCGCCUUCAGCAGGCUGCAAAGC GGCGUGCCCAGCAGGUUCUCCGGCUCCGGCAG CGGCACAGACUUCACCCUGACCAUCAGCUCCC UGCAGCCGGAGGACUUCGCCACCUACUAUUGU GCCCAGGCCGGCACCCACCCCACCACCUUCGG CCAAGGCACAAAGGUGGAAAUCAAGAGG | | | |
| Construct 147 | AUGCCCAGACUCUUCUUCUUCCAUCUACUCGG UGUGUGUCUCCUCCUCAAUCAGUUUAGCCGGG CCGUUGCCGACAGCUGGAUGGAGGAGGUCAUC AAGCUCUGCGGCAGGGAGCUCGUGCGGGCCCA GAUCGCCAUCUGCGGCAUGACCACCUGGAGCA AGAGAUCCCUGUCGCAGGAGGACGCGCCACAG ACUCCUCGGCCCGUGGCCGAGAUCGUGCCCAG CUUUAUCAACAAGGACACCGAAACCAUCAACA UGAUGAGCGAGUUCGUGGCCAAACUCGCCCAG GAGCUGAAGCUGACCCUGAGCGAGAUGCAGCC UGCCUUGCCUCAGCUGCAGCAGCAUGUGCCCG UGCUCAAAGAUAGCAGCCUGCUGUUCGAGGAG UUCAAGAAACUGAUCCGGAACCUGCAGAGCGA GGCCGCCGACUCCAGCCCCUCUGAGCUGAAGU ACCUGGGGCUGGACACGCACUCCCGGAAGAAG AGACAGCUCUAUAGCGCCCUGGCCAACAAGUG CUGCAUGUGGGGAUGCACCAAGAGAAGGCCUCG CCCGCUUCUGCGGAGGCGAGGCAGCGGCGGU GGCGGUAGCGGAGGCGGCGGGUCCGACAUACA GAUGACCCAGAGCCCCUCCUCCCUGAGUGCCU CCGUCGGCGACCGGGUGACCAUCACGUGCCGC GCCAGCCAGGGCAUCAGCAAUGCUGUCUG GUACCAGCAGAAGCCCGGGAAGGCGCCCAAGC UGCUGAUCCUGGCGUUCUCCGGCUGCAGUCC GGCGUGCCCAGCAGGUUCAGCGGCUCAGGCUC CGGUACCGACUUCACCCUCUACUAUAAGCAGCC UGCAGCCGGAGGAUUUUGCCACCUACUACUGC GCCCAGGCCGGCACCCACCCAACCACCUUCGG CCAGGGCACCAAGGUGGAGAUCAAGCGG | 5' UTR 1 | 3' UTR 1 | 472 |
| Construct 148 | AUGCCCAGGCUGUUCUUCUUCCACCUCCUCGG CGUGUGCCUCCUCCUCAACCAGUUCAGCCGGG CCGUGGCCGACAGCUGGAUGGAGGAGGUGAUC AAGCUCUGCGGCCGGGAGCUCGUGCGGGCCCA GAUCGCCAUCUGCGGCAUGAGCACCUGGAGCA AGCGGAGCCUGAGCCAGGAGGACGCCCCGCAG ACUCCGCGGCCAGUGGCCGAGAUCGUGCCCAG CUUCAUCAACAAGGACACCGAAACCAUCAACA UGAUGAGCGAGUUCGUGGCCAACCUGCCCCAG GAGCUGAAGCUGACCCUGAGCGAGAUGCAGCC CGCUCUGCCGCAGCUGCAGCAGCACGUGCCCG UGCUGAAGGACAGCAGCCUGCUGUUCGAGGAG UUCAAGAAGCUGAUCCGGAACCUGCAGAGCGA GGCCGCAGAUUCUUCUCCUAGCGAGCUCAAGU ACCUGGGCUGGACACCCACAGCGGAAGAAG CGGCAGCUGUACAGCGCCCUGGCCAACAAGUG CUGCCACGUCGGCUGCACCAAGAGGCGCCUGG CCCGGUUCUGCGGCGGCGGUGGAUCUGGCGGA GGAGGCUCGGGAGGCGGCGGCAGCGACAUCCA GAUGACCCAGAGCCCAAGCUCCCUGUCCGCCA GCGUGGGCGACCGGGUGACCAUCACCUGCCGC GCCAGCCAGGCCAUCGGCACCAUGCUGAGCUG GUACCAGCAGAAGCCCGGCAAGGCCCCGAAGC UGCUGAUCCUGGCCUUCUCUAGGCUGCAGAGC GGCGUGCCCAGCCGGUUCAGCGGCUCCGGCUCC CGGCACCGACUUCACCCUGACUAUCUCGAGCC UCCAGCCGGAGGACUUCGCCACCUACUACUGC GCCCAGGCCGGCACCCACCCCACCACCUUCGG CCAGGGCACCAAGGUGGAGAUCAAGCGG | 5' UTR 1 | 3' UTR 1 | 473 |
| Construct 149 | AUGCCCAGGCUGUUCUUCUUCCACCUCCUCGG CGUGUGCCUCCUCCUCAACCAGUUCAGCCGGG CCGUGGCCGACAGCUGGAUGGAGGAGGUGAUC AAGCUCUGCGGCCGGGAGCUCGUGCGGGCCCA GAUCGCCAUCUGCGGCAUGAGCACCUGGAGCA AGCGGAGCCUGAGCCAGGAGGACGCCCCUCAG ACGCCACGCCGGUGGCCGAGAUCGUGCCAG CUUCAUCAACAAGGACACCGAGACAAUCAACA UGAUGAGCGAGUUCGUGGCCAACCUGCCCAG GAGCUGAAGCUGACCCUGAGCGAGAUGCAGCC CGCCCUGCCGCAGCUGCAGCAGCACGUGCCCG UGCUGAAGGACAGCAGCCUGCUGUUCGAGGAG UUCAAGAAGCUGAUCCGGAACCUGCAGAGCGA GGCCGCCGACUCCAGCCCCAGCGAAUUGAAGU ACCUGGGCUGGGACACCACCACCGCGGAAGAAG CGGCAGCUGUACAGCGCCCUGGCCAACAAGUG CUGCCACGUGGGCUGCACCAAGAGGAGUCUGG CCCGGUUCUGCGGCGGAGGCGGAAGCGGUGGA GGCGGCUCGGGAGGCGGCGGCUCGGACAUCCA GAUGACCCAGAGCCCGUCCUCCCUGUCCGCCA GCGUGGGCGACCGGGUGACCAUCACCUGCCGG GCCAGCCAGGCCCAUCGGCACCAUGCUGAGCUG GUACCAGCAGAAGCCCGGCAAGGCCCCGAAGC UGCUGAUCCUGGCCUUCAGCAGGCUGCAGAGC GGCGUGCCGAGCCGGUUCAGCGGUAGCGGCUC CGGCACCGACUUCACCCUGACAAUCAGCUCGC UGCAGCCAGGAGCUUCGCCACCUACCUACUGC GCCCAGGCCGGCACCCACCCCACCACCUUCGG CCAGGGCACCAAGGUGGAGAUCAAGCGG | 5' UTR 1 | 3' UTR 1 | 474 |
| Construct 150 | AUGCCCAGCUGUUCUUCUUCCACCUCUUGGG CGUGUGCCUCCUCCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGUCCACCUGGUCCA AGCUCCCUCUCCCAGGAGGACGCCCGCAG ACCCCGCGCCCGUCGCCGAGAUCGUCCCCUC CUUCAUCAACAAGGACACCGAGACGAUCAACA UGAUGUCCGAGUUCGUCGCCAACCUCCCACAG GAGCUCAAGCUCACCCUCUCCGAGAUGCAGCC CGCCCUGCCGCAGCUCCAGCAGCACGUCCCCG UCCUCAAGGACUCCUCCCUCCUCUUCGAGGAG UUCAAGAAGCUCAUCCGCAACCGCCAGUCCGA GGCCGCCGACAGCAGCCCGUCCGAGCUGAAGU ACCUCGGCCUCGACACCCACUCCCGCAAGAAG CGCCAGCUCUACUCCGCCCUCGCCAACAAGUG CUGCCACGUCGGCUGCACCAAGAGGAGCCUGG CCCGCUUCUGCGGCGGAGGCGGCAGCGGCGGC GGUGGAUCGGUGGCGGCGAAGCGACAUCCA GAUGACCCAGAGCCCGAGCAGCCUGAGCGCCU CCGUCGGCGACCGCGUCACCAUCACCUGCCGC GCCUCCCAGGGCAUCAGCAACGCCCUUAGCC UGGUACCAGCAGAAGCCCGGCAAGGCCCCUAAGC UCCUCAUCCUCGCCUUCUCCCGCCUCCAGUCC GGCGUGCCGAGCCGGUUCUCCGGAAGCGGCUC GGGCACCGACUUCACCCUCACCAUCUCCUCAC UCCAGCCGGAGGACUUCGCCACCUACUACUGC GCCCAGGCCGGCACCCACCCCACCACCUUCGG CCAGGGCACCAAGGUCGAGAUCAAGCGC | 5' UTR 1 | 3' UTR 1 | 475 |
| Construct 151 | AUGCCCAGACUGUUCUUCUUCCACCUCCUCGG CGUGUGCCUCCUCCUCAACCAGUUCAGCCGGG CCGUGGCCGACAGCUGGAUGGAGGAGGUCAUC AAGCUCUGCGGCCGCGAGCUCGUCCGCGCCCA GAUCGCCAUCUGCGGCAUGUCCACCUGGUCCA AGCGCUCCCUCUCCCAGGAGGACGCCCCGCAG ACGCCGCGCCCGUCGCCGAGAUCGUCCCCUC CUUCAUCAACAAGGACACCGAGACAAUCAACA UGAUGUCCGAGUUCGUCGCCAACCUCCCACAG GAGCUCAAGCUCACCCUCUCCGAGAUGCAGCC CGCCCUGCCGCAACUCCAGCAGCACGUCCCCG UCCUCAAGGACUCCUCCCUCCUCUUCGAGGAG UUCAAGAAGCUCAUCCGCAACCGCCAGUCCGA GGCCGCCGACUCCAGCCCCUCCGAGCUGAAGU | 5' UTR 1 | 3' UTR 1 | 476 |

TABLE 7-continued

RNA Sequences

| Name | Sequence | 5' UTR | 3' UTR | SEQ ID NO: |
|---|---|---|---|---|
| | ACCUCGGCCUCGACACCCACUCCCGCAAGAAG<br>CGCCAGCUCUACUCCGCCCUCGCCAACAAGUG<br>CUGCCACGUCGGCUGCACCAAGCGGAGCCUGG<br>CCCGCUUCUGCGGCGGUGGCGGAAGCGGAGGC<br>GGAGGCAGCGGCGGAGGUGGCUCCGACAUCCA<br>GAUGACCCAGAGCCCUAGCUCUCUGAGCGCCU<br>CCGUCGGCGACCGCGUCACCAUCACCUGCCGC<br>GCCUCCCGCCCCAUCGGCACCAUGCUCUCCUG<br>GUACCAGCAGAAGCCCGGCAAGGCCCCCAAGC<br>UCCUCAUCCUCGCCUUCUCCCGCCUCCAGUCC<br>GGCGUGCCGUCCCGGUUCAGCGGCUCCGGCAG<br>CGGAACCGACUUCACCCUGACGAUCAGCUCCC<br>UGCAGCCUGAGGACUUCGCCACCUACUACUGC<br>GCCCAGGCCGGCACCCACCCCACCACCUUCGG<br>CCAGGGCACCAAGGUCGAGAUCAAGCGC | | | |
| Construct 152 | AUGCCCCGGCUGUUCUUCUUCCACCUGCUGGG<br>CGUGUGCCUGCUGCUGAACCAGUUCAGCCGGG<br>CCGUGGCCGACAGCUGGAUGGAGGAGGAUGAUC<br>AAGCUGUGCGGCCGGGAGCUGGUGCGGGCCCA<br>GAUCGCCAUCUGCGGCAUGAGCACCUGGAGCA<br>AGCGGAGCCUGAGCCAGGAGGACGCACCCCAG<br>ACCCCACGGCCCGUGGCCGAGAUCGUGCCCAG<br>CUUCAUCAACAAGGACACCGAGACCAUCAACA<br>UGAUGAGCGAGUUCGUGGCCAACCUGCCCCAG<br>GAGCUGAAGCUGACCCUGAGCGAGAUGCAGCC<br>CGCCCUGCCCCAGCUGCAGCAGCACGUGCCCG<br>UGCUGAAGGACAGCAGCCUGCUGUUCGAGGAG<br>UUCAAGAAGCUGAUCCGGAACCGGCAGAGCGA<br>GGCCGCCGACAGCAGCCCCAGCGAGCUGAAGU<br>ACCUGGCCUGGACACCCACAGCCGGAAGAAG<br>CGGCAGCUGUACAGCGCCUGGCCUGAACAAG<br>UGCUGCCACGUGGGCUGCACCAAGCGGAGCCUGG<br>CCCGGUUCUGCGGCGGCGGCGGCAGCGGCGGC<br>GGCGGCAGCGGCGGCGGCGGCAGCGACAUCCA<br>GAUGACCCAGAGCCCCAGCAGCCUGAGCGCCA<br>GCGUGGGCGACCGGGUGACCAUCACCUGCCGG<br>GCCAGCCGGCCCAUCGGCACCAUGCUGAGCUG<br>GUACCAGCAGAAGCCCGGCAAGGCCCCCAAGC<br>UGCUGAUCCUGGCCUUCAGCCGGCUGCAGAGC<br>GGCGUGCCCAGCCGGUUCAGCGGCAGCGGCAG<br>CGGCACCGACUUCACCCUGACCAUCAGCAGCC<br>UGCAGCCCGAGGACUUCGCCACCUACUACUGC<br>GCCCAGGCCGGCACCCACCCCACCACCUUCGG<br>CCAGGGCACCAAGGUGGAGAUCAAGCGG | 5' UTR 1 | 3' UTR 1 | 477 |
| Construct 153 | AUGCCCCGGCUGUUCUUCUUCCACCUGCUGGG<br>CGUGUGCCUGCUGCUGAACCAGUUCAGCCGGG<br>CCGUGGCCGACAGCUGGAUGGAGGAGGAUGAUC<br>AAGCUGUGCGGGAGGGAGCUGGUGAGGGCGC<br>AGAUCGCGAUCUGCGGGAUGAGCACGUGGAGC<br>AAGAGGAGCCUGAGCCAGGAGGACGCGCCGCA<br>GACGCCGAGGCCGGUGGCGGAGAUCGUGCCGA<br>GCUUCAUCAACAAGGACACGGAGACGAUCAAC<br>AUGAUGAGCGAGUUCGUGGCGAACCUGCCGCA<br>GGAGCUGAAGCUGACCCUGAGCGAGAUGCAGC<br>CGGCGCUGCCGCAGCUGCAGCAGCACGUGCCG<br>GUGCUGAAGGACAGCAGCCUGCUGUUCGAGGA<br>GUUCAAGAAGCUGAUCAGGAACAGGCAGAGC<br>GAGGCGGCGGACAGCAGCCCGAGCGAGCUGAA<br>GUACCUGGGGCUGGACACCACAGCCGGAAGA<br>AGAGGCAGCUGUACAGCGCGCUGGCGAACAAG<br>UGCUGCCACGUGGGGUGCACGAAGAGGAGCCU<br>GGCGAGGUUCUGCGGAGGCGGUGGGAGCGGU<br>GGCGGAGGCAGCGGCGGAGGCGGGAGCGACA<br>UCCAGAUGACGCAGAGCCCGAGCAGCCUGAGC<br>GCGAGCGUGGGGGACAGGGUGACGAUCACGU<br>GCAGGGCGAGCAGGCCGAUCGGGACGAUGCUG<br>AGCUGGUACCAGCAGAAGCCCGGCAAGGCCCC<br>GAAGCUGCUGAUCCUGGCGUUCAGCAGGCUGC<br>AGAGCGGGGUGCCGAGCAGGUUCAGCGGGAGC<br>GGGAGCGGGACGGACUUCACGCUGACGAUCAG<br>CAGCCUGCAGCCGGAGGACUUCGCGACGUACU<br>ACUGCGCGCAGGCGGGGACGCACCCGACGACG | 5' UTR 1 | 3' UTR 1 | 478 |
| | UUCGGGCAGGGGACGAAGGUGGAGAUCAAGA<br>GG | | | |
| Construct 154 | AUGCCCCGGCUGUUCUUCUUCCACCUGCUGGG<br>CGUGUGCCUGCUGCUGAACCAGUUCAGCCGGG<br>CCGUGGCCGACAGCUGGAUGGAGGAGGUCAUC<br>AAGCUCUGCGGCCGCGAGCUCGUCCGCGCCCA<br>GAUCGCCAUCUGCGGCAUGUCCACCUGGUCCA<br>AGCGCUCCCUCUCCCAGGAGGACGCACCCCAG<br>ACACCCCGCCCCGUCGCCGAGAUCGUCCCCUC<br>CUUCAUCAACAAGGACACCGAGACCAUCAACA<br>UGAUGUCCGAGUUCGUCGCCAACCUCCCCCAG<br>GAGCUCAAGCUCACCCUCUCCGAGAUGCAGCC<br>CGCCCUCCCCCAGCUCCAGCAGCACGUCCCCG<br>UCCUCAAGGACUCCUCCCUCCUCUUCGAGGAG<br>UUCAAGAAGCUCAUCCGCAACCGCCAGUCCGA<br>GGCCGCCGACUCCUCCCCCUCCGAGCUCAAGU<br>ACCUCGGCCUCGACACCCACUCCCGCAAGAAG<br>CGCCAGCUCUACUCCGCCCUCGCCAACAAGUG<br>CUGCCACGUCGGCUGCACCAAGCGCUCCCUCG<br>CCCGCUUCUGCGGCGGCGGCGGCUCCGGCGGC<br>GGCGGCUCCGGCGGCGGCGGCUCCGACAUCCA<br>GAUGACCCAGUCCCCCUCCUCUCUCUCCGCCU<br>CCGUCGGCGACCGCGUCACCAUCACCUGCCGC<br>GCCUCCCGCCCCAUCGGCACCAUGCUCUCCUG<br>GUACCAGCAGAAGCCCGGCAAGGCCCCCAAGC<br>UCCUCAUCCUCGCCUUCUCCCGCCUCCAGUCC<br>GGCGUCCCCUCCCGCUUCUCCGGCUCCGGCUC<br>CGGCACCGACUUCACCCUCACCAUCUCCUCCC<br>UCCAGCCCGAGGACUUCGCCACCUACUACUGC<br>GCCCAGGCCGGCACCCACCCCACCACCUUCGG<br>CCAGGGCACCAAGGUCGAGAUCAAGCGC | 5' UTR 1 | 3' UTR 1 | 479 |
| Construct 155 | AUGCCUCGCCUGUUUUUUUUCCACCUGCUAGG<br>AGUCUGUUUACUACUGAACCAAUUUCCAGAG<br>CAGUCGCGACUCAUGAUGGAGGAAGUUAU<br>UAAAUUAUGCGGCCGCGAAUUAGUUCGCGCGC<br>AGAUUGCCAUUUGCGGCAUGAGCACCUGGAGC<br>AAAAAGGUCUCUGAGCCAGGAAGAUGCUCCUCA<br>GACACCUAGACCGGUGGCAGAAAUUGUGCCAU<br>CCUUCAUCAACAAAGAUACAGAAACCAUAAAU<br>AUGAUGUCAGAAUUUGUUGCUAAUUUGCCAC<br>AGGAGCUGAAGUUAACCCUGUCUGAGAUGCA<br>GCCAGCAUUCCACAGCUACAACAACAAUGUAC<br>CUGUAUUAAAAGAUUCCAGUCUUCUCUUUGA<br>AGAAUUUAAGAAACUUAUUCGCAAUAGACAA<br>AGUGAAGCCGCAGACAGCAGUCCUUCAGAAUU<br>AAAAUACUUAGCCUGGAUACUCAUUCUCGA<br>AAAAAGACAACUCUACAGUGCAUUGGCUA<br>AUAAAUGUUGCCAUGUUGGUUGUACCAAAAG<br>AUCUCUUGCUAGAUUUUGCGGUGGCGGAGGC<br>AGCGGAGGUGGUGGCGGCGGGCGGAGGUGGCA<br>GCGACAUCCAGAUGACCCAGAGCCCCAGCAGC<br>CUGAGCGCCAGCGUGGGCGACAGGGUGACCAU<br>CACCUGCAGGGCCAGCAGGCCCAUCGGCACCA<br>UGCUGAGCUGGUACCAGCAGAAGCCCGGCAAG<br>GCCCCCAAGCUGCUGAUCCUGGCCUUCAGCAG<br>GCUGCAGAGCGGCGUGCCCAGCAGGUUCAGCG<br>GCAGCGGCAGCGGCACCGACUUCACCCUGACC<br>AUCAGCAGCCUGCAGCCCGAGGACUUCGCCAC<br>CUACUACUGCGCCCAGGCCGGCACCCACCCCA<br>CCACCUUCGGCCAGGGCACCAAGGUGGAGAUC<br>AAGAGG | 5' UTR 1 | 3' UTR 2 | 480 |
| Construct 156 | AUGCCUCGCCUGUUUUUUUUCCACCUGCUAGG<br>AGUCUGUUUACUACUGAACCAAUUUCCAGAG<br>CAGUCGCGGACUCAUGAUGGAGGAAGUUAU<br>UAAAUUAUGCGGCCGCGAAUUAGUUCGCGCGC<br>AGAUUGCCAUUUGCGGCAUGAGCACCUGGAGC<br>AAAAAGGUCUCUGAGCCAGGAAGAUGCUCCUCA<br>GACACCUAGACCAGUGGCAGAAAUUGUGCCAU<br>CCUUCAUCAACAAAGAUACAGAAACCAUAAAU<br>AUGAUGUCAGAAUUUGUUGCUAAUUUGCCAC<br>AGGAGCUGAAGUUAACCCUGUCUGAGAUGCA | 5' UTR 1 | 3' UTR 1 | 481 |

TABLE 7-continued

RNA Sequences

| Name | Sequence | 5' UTR | 3' UTR | SEQ ID NO: |
|---|---|---|---|---|
| | GCCAGCAUUACCACAGCUACAACAACAUGUAC<br>CUGUAUUAAAAGAUUCCAGUCUUCUCUUUGA<br>AGAAUUUAAGAAACUUAUUCGCAAUAGACAA<br>AGUGAAGCCGCAGACAGCAGUCCUUCAGAAUU<br>AAAAAUACUUAGGCUUGGAUACUCAUUCUCGA<br>AAAAAGAGACAACUCUACAGUGCAUUGGCUA<br>AUAAAUGUUGCCAUGUUGGUUGUACCAAAAG<br>AUCUCUUGCUAGAUUUUGCGGUGGCGGAGGC<br>AGCGGAGGUGGUGGCAGCGGCGGAGGUGGCA<br>GCGACAUCCAGAUGACCCAGAGCCCCAGCAGC<br>CUGAGCGCCAGCGUGGGCGACAGGGUGACCAU<br>CACCUGCAGGGCCAGCAGGCCCAUCGGCACCA<br>UGCUGAGCUGGUACCAGCAGAAGCCCGGCAAG<br>GCCCCCAAGCUGCUGAUCCUGGCCUUCAGCAG<br>GCUGCAGAGCGGCGUGCCCAGCAGGUUCAGCG<br>GCAGCGGCAGCGGCACCGACUUCACCCUGACC<br>AUCAGCAGCCUGCAGCCCGAGGACUUCGCCAC<br>CUACUACUGCGCCCAGGCCGGCACCCACCCCA<br>CCACCUUCGGCCAGGGCACCAAGGUGGAGAUC<br>AAGAGG | | | |
| Con-<br>struct<br>157 | AUGCCCGCCUGUUCUUCUUCCACCUCCUUGG<br>CGUGUGCCUCCUCCUCAACCAGUUCAGCCGGG<br>CCGUGGCCGACAGCUGGAUGGAGGAGGUCAUC<br>AAGCUCUGCGGCCGCGAGCUCGUCCGCGCCCA<br>GAUCGCCAUCUGCGGCAUGUCCACCUGGUCCA<br>AGCGCUCCCUCUCCCAGGAGGACGCGCCCACAG<br>ACCCCGCGCCCCGUCGCCGAGAUCGUCCCCUC<br>CUUCAUCAACAAGGACACCGAGACGAUCAACA<br>UGAUGUCCGAGUUCGUCGCCAACCUGCCGCAG<br>GAGCUCAAGCUCACCCUCUCCGAGAUGCAGCC<br>CGCCCUCCCGCAGCUCCAGCAGCACGUCCCCG<br>UCCUCAAGGACUCCUCCCUCCUCUUCGAGGAG<br>UUCAAGAAGCUCAUCCGCAACCGCCAGUCCGA<br>GGCCGCCGACUCCAGCCCCUCCGAGCUGAAGU<br>ACCCGGCCUGCGACACCCACUCCCGCAAGAG<br>CGCCAGCUCUACUCCGCCCUCGCCAACAAGUG<br>CUGCCACGUCGGCUGCACCAAGCGGUCCCUGG<br>CCCGCUUCUGCGGAGGCGGCGGCUCUGGCGGU<br>GGUGGAUCCGGCGGCGGUGGCAGCGGCGACAUCCA<br>GAUGACCCAGUCCCCAUCCAGCCUGAGCGCCU<br>CCGUCGGCGACCGCGUCACCAUCACCUGCCGC<br>GCCUCCCGCCCAUCGGCACCAUGCUCUCCUG<br>GUACCAGCAGAAGCCCGGCAAGGCCCCGAAGC<br>UCCUCAUCCUCGCUUCUCCGCCUCCAGUCC<br>GGCGUCCCGUCAAGGUUCUCCGGCUCGGGCUC<br>CGGUACCGACUUCACCCUCACCAUCUCCUCGC<br>UCCAGCCAGAGGACUUCGCCACCUACUACUGC<br>GCCCAGGCCGGCACCCACCCCACCACCUUCGG<br>CCAGGGCACCAAGGUCGAGAUCAAGCGC | 5'<br>UTR<br>1 | 3'<br>UTR<br>3 | 482 |
| 5'<br>UTR 1 | UCAAGCUUUUGGACCCUCGUACAGAAGCUAAU<br>ACGACUCACUAUAGGGAAAUAAGAGAGAAAA<br>GAAGAGUAAGAAGAAAUAUAAGAGCCACC | | | 483 |
| 3'<br>UTR 1 | UGAUAAUAGUCCAUAAAGUAGGAAACACUAC<br>AGCUGGAGCCUCGGUGGCCAUGCUUCUUGCCC<br>CUUGGGCCUCCCCCAGCCCCUCCUCCCCUUCC<br>UGCACCCGUACCCCCGCAUUAUUACUCACGG<br>UACGAGUGGUCUUUGAAUAAAGUCUGAGUGG<br>GCGGC | | | 484 |
| 3'<br>UTR 2 | UGAUAAUAGGCUGGAGCCUCGGUGGCCAUGCU<br>UCUUGCCCCUUGGGCCUCCCCCAGCCCCUCC<br>UCCCCUUCCUGCACCCGUACCCCGUGGUCUU<br>UGAAUAAAGUCUGAGUGGGCGGC | | | 485 |
| 3'<br>UTR 3 | UGAUAAUAGGCUGGAGCCUCGGUGGCCAUGCU<br>UCUUGCCCCUUGGGCCUCCCCCAGCCCCUCC<br>UCCCCUUCCUGCACCCGUACCCCCGCAUUAU<br>UACUCACGGUACGAGUGGUCUUUGAAUAAAG<br>UCUGAGUGGGCGGC | | | 486 |

TABLE 7-continued

RNA Sequences

| Name | Sequence | 5' UTR | 3' UTR | SEQ ID NO: |
|---|---|---|---|---|
| 3'<br>UTR 4 | UGAUAAUAGGCUGGAGCCUCGGUGGCCAUGCU<br>UCUUGCCCCUUGGGCCUCCCCCAGCCCCUCC<br>UCCCCUUCCUGCACCCGUACCCCCUCCAUAAA<br>GUAGGAAACACUACAGUGGUCUUUGAAUAAA<br>GUCUGAGUGGGCGGC | | | 487 |
| Relax-<br>in 2,<br>trans-<br>cript<br>vari-<br>ant 1<br>[Homo<br>sapi-<br>ens] | GUCCCGACCUCCAGGAGAGACCAGGCCCAGGA<br>UGCCUCGCCUGUUUUUUUCCACCUGCUAGGA<br>GUCUGUUUACUACUGAACCAAUUUUCCAGAGC<br>AGUCGCGGACUCAUGGAUGGAGGAAGUUAUU<br>AAAUUAUGCGGCCGCGAAUUAGUUCGCGCGCA<br>GAUUGCCAUUUGCGGCAUGAGCACCUGGAGCA<br>AAAGGUCUCUGAGCCAGGAAGAUGCUCCUCAG<br>ACACCUAGACCAGUGGCAGGUGAUUUGUGCCAUC<br>CUUCAUCAACAAAGAUACAGAAACCAUAAAU<br>AUGAUGUCAGAAUUUGUUGCUAAAUUUGCCACA<br>GGAGCUGAAGUUAACCCUGUCUGAGAUGCAGC<br>CAGCAUUACCACAGCUACAACAACAUGUACCU<br>GUAUUAAAAGAUUCCAGUCUUCUCUUUGAAG<br>AAUUUAAGAAACUUAUUCGCAAUAGACAAAG<br>UGAAGCCGCAGACAGCAGUCCUUCAGAAUUAA<br>AAUACUUAGGCUUGGAUACUCAUUCUCGAAA<br>AAAGAGACAACUCUACAGUGCAUUGGCUAAU<br>AAAUGUUGCCAUGUUGGUUGUACCAAAAGAU<br>CUCUUGCUAGAUUUUGCUGAGAUGAAGCUAA<br>UUGUGCACAUCUGUAUAAUAUUCACACAUAU<br>UCUUAAUGCAUUUCACUGAUGCUUCUAUCAG<br>GUCCCAUCAAUUCUUAGAAUAUCUAAGAAUCU<br>UUGUUAGAUAUUAGGUCCCAUCAAUUCUUAG<br>AAUAUCUAAACAUCUUUGUUGAUGUUUAGAU<br>UUUUUAUUUGAUGUGUAAAGAAAAAUGUUCUU<br>UGUGUGAUUAAAUGACACAUUUUUUUGCUGA<br>AAAAAAAAAAAAA | | | 488 |
| RLN2,<br>Pro-<br>laxin<br>H2,<br>iso-<br>form 1 | AUGCCUCGCCUGUUUUUUUCCACCUGCUAGG<br>AGUCUGUUUACUACUGAACCAAUUUUCCAGAG<br>CAGUCGCGGACUCAUGGAUGGAGGAAGUUAU<br>UAAAUUAUGCGGCCGCGAAUUAGUUCGCGCGC<br>AGAUUGCCAUUUGCGGCAUGAGCACCUGGAGC<br>AAAAGGUCUCUGAGCCAGGAAGAUGCUCCUCA<br>GACACCUAGACCAGUGGCAGAAAUUGUGCCAU<br>CCUUCAUCAACAAAGAUACAGAAACCAUAAAU<br>AUGAUGUCAGAAUUUGUUGCUAAAUUUGCCAC<br>AGGAGCUGAAGUUAACCCUGUCUGAGAUGCA<br>GCCAGCAUUACCACAGCUACAACAACAUGUAC<br>CUGUAUUAAAAGAUUCCAGUCUUCUCUUUGA<br>AGAAUUUAAGAAACUUAUUCGCAAUAGACAA<br>AGUGAAGCCGCAGACAGCAGUCCUUCAGAAUU<br>AAAAUACUUAGGCUUGGAUACUCAUUCUCGA<br>AAAAAGAGACAACUCUACAGUGCAUUGGCUA<br>AUAAAUGUUGCCAUGUUGGUUGUACCAAAAG<br>AUCUCUUGCUAGAUUUUGC | | | 489 |
| Relax-<br>in 2,<br>trans-<br>cript<br>vari-<br>ant 2<br>[Homo<br>sapi-<br>ens] | GUCCCGACCUCCAGGAGAGACCAGGCCCAGGA<br>UGCCUCGCCUGUUUUUUUCCACCUGCUAGGA<br>GUCUGUUUACUACUGAACCAAUUUUCCAGAGC<br>AGUCGCGGACUCAUGGAUGGAGGAAGUUAUU<br>AAAUUAUGCGGCCGCGAAUUAGUUCGCGCGCA<br>GAUUGCCAUUUGCGGCAUGAGCACCUGGAGCA<br>AAAGGUCUCUGAGCCAGGAAGAUGCUCCUCAG<br>ACACCUAGACCAGUGGCAGGUGAUUUUAUUCA<br>AACAGUCUCACUGGGAAUCUCACCGGACGGAG<br>GGAAAGCACUGAGAACAGGAAGCUGCUUCACC<br>CGAGAGUUCCUUGGUGCCCUUUCCAAAUUGUG<br>CCAUCCUUCAUCAACAAAGAUACAGAAACCAU<br>AAAUAUGAUGUCAGAAUUUGUUGCUAAAUUUG<br>CCACAGGAGCUGAAGUUAACCCUGUCUGAGAU<br>GCAGCCAGCAUUACCACAGCUACAACAACAUG<br>UACCUGUAUUAAAAGAUUCCAGUCUUCUCUUU<br>GAAGAAUUUAAGAAACUUAUUCGCAAUAGAC<br>AAAGUGAAGCCGCAGACAGCAGUCCUUCAGAA<br>UUAAAAUACUUAGGCUUGGAUACUCAUUCUC<br>GAAAAAAGAGACAACUCUACAGUGCAUUGGC | | | 490 |

TABLE 7-continued

RNA Sequences

| Name | Sequence | 5' UTR | 3' UTR | SEQ ID NO: |
|---|---|---|---|---|
| | UAAUAAAUGUUGCCAUGUUGGUUGUACCAAA AGAUCUCUUGCUAGAUUUUGCUGAGAUGAAG CUAAUUGUGCACAUCUCGUAUAAUAUUCACAC AUAUUCUUAAUGACAUUUCACUGAUGCUUCU AUCAGGUCCCAUCAAUUCUUAGAAUAUCUAAG AAUCUUUGUUAGAUAUUAGGUCCCAUCAAUU CUUAGAAUAUCUAAACAUCUUUGUUGAUGUU UAGAUUUUUUAUUUGAUGUGUAAGAAAAUG UUCUUUGUGUGAUUAAAUGACACAUUUUUUU GCUGAAAAAAAAAA | | | |
| RLN2, Prorelaxin H2, isoform 2 | AUGCCUCGCCUGUUUUUUUUCCACCUGCUAGG AGUCUGUUUACUACUGAACCAAUUUUCCAGAG CAGUCGCGGACUCAUGGAUGGAGGAAGUUAU UAAAUUAUGCGGCCGCGAAUUAGUUCGCGCGC AGAUUGCCAUUUGCGGCAUGAGCACCUGGAGC AAAAGGUCUCUGAGCCAGGAAGAUGCUCCUCA GACACCUAGACCAGUGGCAGGUGAUUUUAUUC AAACAGUCUCACUGGGAAUCUCACCGGACGGA GGGAAAGCACUGAGAACAGGAAGCUGCUUCAC CCGAGAGUUCCUUGGUGCCCUUUCCAAAUUGU GCCAUCCUUCAUCAACAAAGAUACAGAAACCA | | | 491 |

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance. The breadth and scope of the present invention should not be limited by any of the above-described exemplary embodiments, but should be defined only in accordance with the following claims and their equivalents.

All publications, patent applications, patents, and other references mentioned herein are incorporated by reference in their entirety. In case of conflict, the present specification, including definitions, will control.

SEQUENCE LISTING (589 sequences)

SEQ ID NO: 1 - protein, 185 aa, Homo sapiens
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 2 - DNA, 555 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 3 - protein, 117 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAGDFIQTVSLGISPDGGKALRTGSCFTREFLGALSKLCHPSSTKIQKP

SEQ ID NO: 4 - DNA, 351 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtgccatccttcatcaacaaagatacagaaacca

SEQ ID NO: 5 - RNA, 924 nt, Artificial Sequence
  Synthetic Polynucleotide
augccccgccuguucuucuuccaccuccuuggcgugugccuccuccucaaccaguucagccgggccguggccgacagcuggauggaggaggucaucaagcucugcggccgcgagcucguccgcgcccagaucgccaucugcggcauguccaccugguccaagcgcucccucucccaggaggacgccccacagaccccgcgccccgucgccgagaucguccccuccuucaucaacaaggacaccgagacgaucaacaugauguccgaguucgucgccaaccugccgcaggagcucaagcucacccucuccgagaugcagcccgcccucccgcagcuccagcagcacguccccguccucaaggacuccucccuccucuucgaggaguucaagaagcucauccgcaaccgccaguccgaggccgccgacuccagccccuccgagcugaaguaccucggccucgacacccacucccgcaagaagcgccagcucuacuccgcccucgccaacaagugcugccacgucggcugcaccaagcggucccuggcccgcuucugcggaggcggcggcucuggcggugguggauccggcggcgguggcagcgacauccagaugacccaguccccauccagccugagcgccuccgucggcgaccgcgucaccaucaccugccgcgccucccgccccaucggcaccaugcucuccugguaccagcagaagcccggcaaggccccgaagcuccucauccucgccuucucccgccuccaguccggcgucccgucaagguucuccggcucgggcuccgguaccgacuucacccucaccaucuccucgcuccagccagaggacuucgccaccuacuacugcgcccaggccggcacccaccccaccaccuucggccagggcaccaaggucgagaucaagcgc

SEQ ID NO: 6 - protein, 308 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFCGGGGSGGGGSGGGGSDIQMTQSPSSLSASVGDRVTITCRASRPIGTMLSWYQQKPGKAPKLLILAFSRLQSGVPSRFSGSGSGTDFTLTISSLQPEDFATYYCAQAGTHPTTFGQGTKVEIKR

SEQ ID NO: 7 - protein, 308 aa, Artificial Sequence; identical to SEQ ID NO: 6
  Synthetic Polypeptide

SEQ ID NO: 8 - protein, 185 aa, Artificial Sequence; identical to SEQ ID NO: 1
  Synthetic Polypeptide

SEQ ID NO: 9 - protein, 173 aa, Artificial Sequence
  Synthetic Polypeptide
MPRLFFFHLLGVCLLLNQFSRAVADSWMEEVIKLCGRELVRAQIAICGMGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSQLYSALANKCCHVGCTKRSLARFC

SEQ ID NO: 10 - protein, 173 aa, Artificial Sequence
  Synthetic Polypeptide
MPRLFFFHLLGVCLLLNQFSRAVADSWMEEVIKLCGRELVRAQIAICGMGGGGSGGGGSGGGGSGGGGSGGGGSGGGGSGGGGSFQSSSSKAPPPSLPSPSRLPGPSDTPILPQGGGGSGGGGSGGGGSGGGGSGGGGSGGGGSGGGGSQLYSALANKCCHVGCTKRSLARFC

SEQ ID NO: 11 - protein, 419 aa, Artificial Sequence
  Synthetic Polypeptide
MPRLFFFHLLGVCLLLNQFSRAVADSWMEEVIKLCGRELVRAQIAICGMEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRKSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 12 - protein, 185 aa, Artificial Sequence; identical to SEQ ID NO: 1
  Synthetic Polypeptide

SEQ ID NO: 13 - protein, 185 aa, Artificial Sequence; identical to SEQ ID NO: 1
  Synthetic Polypeptide

SEQ ID NO: 14 - protein, 185 aa, Artificial Sequence; identical to SEQ ID NO: 1
  Synthetic Polypeptide

SEQ ID NO: 15 - protein, 185 aa, Artificial Sequence; identical to SEQ ID NO: 1
  Synthetic Polypeptide

SEQ ID NO: 16 - protein, 185 aa, Artificial Sequence; identical to SEQ ID NO: 1
  Synthetic Polypeptide

SEQ ID NO: 17 - protein, 185 aa, Artificial Sequence; identical to SEQ ID NO: 1
  Synthetic Polypeptide

SEQ ID NO: 18 - protein, 185 aa, Artificial Sequence; identical to SEQ ID NO: 1
  Synthetic Polypeptide

SEQ ID NO: 19 - protein, 185 aa, Artificial Sequence; identical to SEQ ID NO: 1
  Synthetic Polypeptide

SEQ ID NO: 20 - protein, 185 aa, Artificial Sequence; identical to SEQ ID NO: 1
  Synthetic Polypeptide

SEQ ID NO: 21 - protein, 185 aa, Artificial Sequence; identical to SEQ ID NO: 1
  Synthetic Polypeptide

SEQ ID NO: 22 - protein, 185 aa, Artificial Sequence; identical to SEQ ID NO: 1
  Synthetic Polypeptide

SEQ ID NO: 23 - protein, 185 aa, Artificial Sequence; identical to SEQ ID NO: 1
  Synthetic Polypeptide

SEQ ID NO: 24 - protein, 185 aa, Artificial Sequence; identical to SEQ ID NO: 1
  Synthetic Polypeptide

SEQ ID NO: 25 - protein, 185 aa, Artificial Sequence; identical to SEQ ID NO: 1
  Synthetic Polypeptide

SEQ ID NO: 26 - protein, 185 aa, Artificial Sequence; identical to SEQ ID NO: 1
  Synthetic Polypeptide

SEQ ID NO: 27 - protein, 185 aa, Artificial Sequence; identical to SEQ ID NO: 1
  Synthetic Polypeptide

SEQ ID NO: 28 - protein, 185 aa, Artificial Sequence; identical to SEQ ID NO: 1
  Synthetic Polypeptide

SEQ ID NO: 29 - protein, 185 aa, Artificial Sequence; identical to SEQ ID NO: 1
  Synthetic Polypeptide

SEQ ID NO: 30 - protein, 185 aa, Artificial Sequence; identical to SEQ ID NO: 1
  Synthetic Polypeptide

SEQ ID NO: 31 - protein, 185 aa, Artificial Sequence; identical to SEQ ID NO: 1
  Synthetic Polypeptide

SEQ ID NO: 32 - protein, 92 aa, Artificial Sequence
  Synthetic Polypeptide
MPRLFFFHLLGVCLLLNQFSRAVADSWMEEVIKLCGRELVRAQIAICGMSTWSGSNGSTNDSNGSTGSQLYSALANKCCHVGCTKRSLARFC

SEQ ID NO: 33 - protein, 92 aa, Artificial Sequence
  Synthetic Polypeptide
MPRLFFFHLLGVCLLLNQFSRAVADSWMEEVIKLCGRELVRAQIAICGMSTWSGSNGSTNTSNGDTGSQLYSALANKCCHVGCTKRSLARFC

SEQ ID NO: 34 - protein, 92 aa, Artificial Sequence
  Synthetic Polypeptide
MPRLFFFHLLGVCLLLNQFSRAVADSWMEEVIKLCGRELVRAQIAICGMSTWSGSNGKTNTSNGDTGSQLYSALANKCCHVGCTKRSLARFC

SEQ ID NO: 35 - protein, 97 aa, Artificial Sequence
  Synthetic Polypeptide
MPRLFFFHLLGVCLLLNQFSRAVADSWMEEVIKLCGRELVRAQIAICGMSTWSGSTNSGSTSSGNSGSGNSGSQLYSALANKCCHVGCTKRSLARFC

SEQ ID NO: 36 - protein, 97 aa, Artificial Sequence
  Synthetic Polypeptide
MPRLFFFHLLGVCLLLNQFSRAVADSWMEEVIKLCGRELVRAQIAICGMSTWSGSTNSGSDTSSGNSGSGNSGQLYSALANKCCHVGCTKRSLARFC

SEQ ID NO: 37 - protein, 97 aa, Artificial Sequence
  Synthetic Polypeptide
MPRLFFFHLLGVCLLLNQFSRAVADSWMEEVIKLCGRELVRAQIAICGMSTWSGSTNSGSDTGSGNSKSGNSGQLYSALANKCCHVGCTKRSLARFC

SEQ ID NO: 38 - protein, 97 aa, Artificial Sequence
  Synthetic Polypeptide
MPRLFFFHLLGVCLLLNQFSRAVADSWMEEVIKLCGRELVRAQIAICGMSTWSGSTNSGSDTSGKNSGDGNSGQLYSALANKCCHVGCTKRSLARFC

SEQ ID NO: 39 - protein, 97 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGQLYSALANKCCHVGCTKRSLARFC

SEQ ID NO: 40 - protein, 107 aa, Artificial Sequence
  Synthetic Polypeptide
MPRLFFFHLLGVCLLLNQFSRAVADSWMEEVIKLCGRELVRAQIAICGMSTWSGSSGSTNDSNGSTGTGSDGSTNGSDGSTGGQLYSALANKCCHVGCTKRSLARFC

SEQ ID NO: 41 - protein, 127 aa, Artificial Sequence
  Synthetic Polypeptide
MPRLFFFHLLGVCLLLNQFSRAVADSWMEEVIKLCGRELVRAQIAICGMSTWSGSTNSGSDTSSGSTNSGSDTSSGNSGSGNSGSKGTGSDGSTNGSNGSTGGQLYSALANKCCHVGCTKRSLARFC

SEQ ID NO: 42 - protein, 447 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFCGGGGSGGGGSGGGGSMVRSVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCAVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGKPIPNPLLGLDSTHHHHHH

SEQ ID NO: 43 - protein, 328 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFCGGGGSGGGGSGGGGSDIQMTQSPSSLSASVGDRVTITCRASRPIGTMLSWYQQKPGKAPKLLILAFSRLQSGVPSRFSGSGSGTDFTLTISSLQPEDFATYYCAQAGTHPTTFGQGTKVEIKRGKPIPNPLLGLDSTHHHHHH

SEQ ID NO: 44 - protein, 97 aa, Artificial Sequence
  Synthetic Polypeptide
MPRLFFFHLLGVCLLLNQFSRAVADSWMEEVIKLCGRELVRAQIAICGMSTWSGSSGGGSGSSSGSSGSGGSGQLYSALANKCCHVGCTKRSLARFC

SEQ ID NO: 45 - protein, 185 aa, Artificial Sequence; identical to SEQ ID NO: 1
  Synthetic Polypeptide

SEQ ID NO: 46 - protein, 178 aa, Artificial Sequence
  Synthetic Polypeptide
MGVKVLFALICIAVAEADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 47 - protein, 412 aa, Artificial Sequence
  Synthetic Polypeptide
MGVKVLFALICIAVAEADSWMEEVIKLCGRELVRAQIAICGMEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRKSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 48 - protein, 166 aa, Artificial Sequence
  Synthetic Polypeptide
MGVKVLFALICIAVAEADSWMEEVIKLCGRELVRAQIAICGMGGGGSGGGGSGGGGSGGGGSGGGGSGGGGSGGGGSFQSSSSKAPPPSLPSPSRLPGPSDTPILPQGGGGSGGGGSGGGGSGGGGSGGGGSGGGGSGGGGSQLYSALANKCCHVGCTKRSLARFC

SEQ ID NO: 49 - protein, 412 aa, Artificial Sequence
  Synthetic Polypeptide
MGVKVLFALICIAVAEADSWMEEVIKLCGRELVRAQIAICGMSTWSEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRKKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 50 - protein, 170 aa, Artificial Sequence
  Synthetic Polypeptide
MGVKVLFALICIAVAEADSWMEEVIKLCGRELVRAQIAICGMSTWSGGGGSGGGGSGGGGSGGGGSGGGGSGGGGSGGGGSFQSSSSKAPPPSLPSPSRLPGPSDTPILPQGGGGSGGGGSGGGGSGGGGSGGGGSGGGGSGGGGSQLYSALANKCCHVGCTKRSLARFC

SEQ ID NO: 51 - protein, 178 aa, Artificial Sequence; identical to SEQ ID NO: 46
  Synthetic Polypeptide

SEQ ID NO: 52 - protein, 186 aa, Artificial Sequence
  Synthetic Polypeptide
MSSRLLLQLLGFWLFLSQPCRARVSEEWMDQVIQVCGRGYARAWIEVCGPSVGRLALSQEEPAPLARQATAEVVPSFINKDAEPFDMTLKCLPNLSEERKAALSEGRAPFPELQQHAPALSDSVVRLEGFKKTFHNQLGEAEDGGPPELKYLGSDAQSRKKRQSGALLSEQCCHIGCTRRSIAKLC

SEQ ID NO: 53 - protein, 412 aa, Artificial Sequence; identical to SEQ ID NO: 49
  Synthetic Polypeptide

SEQ ID NO: 54 - protein, 412 aa, Artificial Sequence; identical to SEQ ID NO: 49
  Synthetic Polypeptide

SEQ ID NO: 55 - protein, 412 aa, Artificial Sequence; identical to SEQ ID NO: 49
  Synthetic Polypeptide

SEQ ID NO: 56 - protein, 412 aa, Artificial Sequence; identical to SEQ ID NO: 49
  Synthetic Polypeptide

SEQ ID NO: 57 - protein, 412 aa, Artificial Sequence; identical to SEQ ID NO: 49
  Synthetic Polypeptide

SEQ ID NO: 58 - protein, 412 aa, Artificial Sequence; identical to SEQ ID NO: 49
  Synthetic Polypeptide

SEQ ID NO: 59 - protein, 412 aa, Artificial Sequence; identical to SEQ ID NO: 49
  Synthetic Polypeptide

SEQ ID NO: 60 - protein, 412 aa, Artificial Sequence; identical to SEQ ID NO: 49
  Synthetic Polypeptide

SEQ ID NO: 61 - protein, 412 aa, Artificial Sequence; identical to SEQ ID NO: 49
  Synthetic Polypeptide

SEQ ID NO: 62 - protein, 412 aa, Artificial Sequence; identical to SEQ ID NO: 49
  Synthetic Polypeptide

SEQ ID NO: 63 - protein, 412 aa, Artificial Sequence; identical to SEQ ID NO: 49
  Synthetic Polypeptide

SEQ ID NO: 64 - protein, 412 aa, Artificial Sequence; identical to SEQ ID NO: 49
  Synthetic Polypeptide

SEQ ID NO: 65 - protein, 412 aa, Artificial Sequence; identical to SEQ ID NO: 49
  Synthetic Polypeptide

SEQ ID NO: 66 - protein, 412 aa, Artificial Sequence; identical to SEQ ID NO: 49
  Synthetic Polypeptide

SEQ ID NO: 67 - protein, 412 aa, Artificial Sequence; identical to SEQ ID NO: 49
  Synthetic Polypeptide

SEQ ID NO: 68 - protein, 412 aa, Artificial Sequence; identical to SEQ ID NO: 49
  Synthetic Polypeptide

SEQ ID NO: 69 - protein, 412 aa, Artificial Sequence; identical to SEQ ID NO: 49
  Synthetic Polypeptide

SEQ ID NO: 70 - protein, 412 aa, Artificial Sequence; identical to SEQ ID NO: 49
  Synthetic Polypeptide

SEQ ID NO: 71 - protein, 412 aa, Artificial Sequence; identical to SEQ ID NO: 49
  Synthetic Polypeptide

SEQ ID NO: 72 - protein, 412 aa, Artificial Sequence; identical to SEQ ID NO: 49
  Synthetic Polypeptide

SEQ ID NO: 73 - protein, 170 aa, Artificial Sequence; identical to SEQ ID NO: 50
  Synthetic Polypeptide

SEQ ID NO: 74 - protein, 170 aa, Artificial Sequence; identical to SEQ ID NO: 50
  Synthetic Polypeptide

SEQ ID NO: 75 - protein, 170 aa, Artificial Sequence; identical to SEQ ID NO: 50
  Synthetic Polypeptide

SEQ ID NO: 76 - protein, 170 aa, Artificial Sequence; identical to SEQ ID NO: 50
  Synthetic Polypeptide

SEQ ID NO: 77 - protein, 170 aa, Artificial Sequence; identical to SEQ ID NO: 50
  Synthetic Polypeptide

SEQ ID NO: 78 - protein, 170 aa, Artificial Sequence; identical to SEQ ID NO: 50
  Synthetic Polypeptide

SEQ ID NO: 79 - protein, 170 aa, Artificial Sequence; identical to SEQ ID NO: 50
  Synthetic Polypeptide

SEQ ID NO: 80 - protein, 170 aa, Artificial Sequence; identical to SEQ ID NO: 50
  Synthetic Polypeptide

SEQ ID NO: 81 - protein, 170 aa, Artificial Sequence; identical to SEQ ID NO: 50
  Synthetic Polypeptide

SEQ ID NO: 82 - protein, 170 aa, Artificial Sequence; identical to SEQ ID NO: 50
  Synthetic Polypeptide

SEQ ID NO: 83 - protein, 412 aa, Artificial Sequence; identical to SEQ ID NO: 47
  Synthetic Polypeptide

SEQ ID NO: 84 - protein, 419 aa, Artificial Sequence
  Synthetic Polypeptide
MPRLFFFHLLGVCLLLNQFSRAVADSWMEEVIKLCGRELVRAQIAICGMSTWSEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRKKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 85 - protein, 177 aa, Artificial Sequence
  Synthetic Polypeptide
MPRLFFFHLLGVCLLLNQFSRAVADSWMEEVIKLCGRELVRAQIAICGMSTWSGGGGSGGGGSGGGGSGGGGSGGGGSGGGGSGGGGSFQSSSSKAPPPSLPSPSRLPGPSDTPILPQGGGGSGGGGSGGGGSGGGGSGGGGSGGGGSGGGGSQLYSALANKCCHVGCTKRSLARFC

SEQ ID NO: 86 - protein, 419 aa, Artificial Sequence; identical to SEQ ID NO: 84
  Synthetic Polypeptide

SEQ ID NO: 87 - protein, 412 aa, Artificial Sequence; identical to SEQ ID NO: 49
  Synthetic Polypeptide

SEQ ID NO: 88 - protein, 419 aa, Artificial Sequence; identical to SEQ ID NO: 84
  Synthetic Polypeptide

SEQ ID NO: 89 - protein, 419 aa, Artificial Sequence; identical to SEQ ID NO: 84
  Synthetic Polypeptide

SEQ ID NO: 90 - protein, 306 aa, Artificial Sequence
  Synthetic Polypeptide
MPRLFFFHLLGVCLLLNQFSRAVADSWMEEVIKLCGRELVRAQIAICGMSTWSEVQLLESGGGLVQPGGSLRLSCVASGFTFNSSAMSWVRQAPGKGLEWVSAISGSGDRTYYADSVKGRFTISRDNSKNTLYLQMNSLRAEDTAVYYCTTDPPRYHYNGLAVRGQGTTVTVSSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 91 - protein, 306 aa, Artificial Sequence
  Synthetic Polypeptide
MPRLFFFHLLGVCLLLNQFSRAVADSWMEEVIKLCGRELVRAQIAICGMSTWSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCTKDPPRYHYTGLAVRGQGTTVTVSSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 92 - protein, 177 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGFQSSSSKAPPPSLPSPSRLPGPSDTPILPQFQSSSSKAPPPSLPSPSRLPGPSDTPILPQGSTDSGSDTSSGNSGDGNSGQLYSALANKCCHVGCTKRSLARFC

SEQ ID NO: 93 - protein, 147 aa, Artificial Sequence
  Synthetic Polypeptide
MPRLFFFHLLGVCLLLNQFSRAVADSWMEEVIKLCGRELVRAQIAICGMSTWSGGGGSFQSSSSKAPPPSLPSPSRLPGPSDTPILPQFQSSSSKAPPPSLPSPSRLPGPSDTPILPQGGGGSQLYSALANKCCHVGCTKRSLARFC

SEQ ID NO: 94 - protein, 419 aa, Artificial Sequence; identical to SEQ ID NO: 84
  Synthetic Polypeptide

SEQ ID NO: 95 - protein, 419 aa, Artificial Sequence; identical to SEQ ID NO: 84
  Synthetic Polypeptide

SEQ ID NO: 96 - protein, 419 aa, Artificial Sequence; identical to SEQ ID NO: 84
  Synthetic Polypeptide

SEQ ID NO: 97 - protein, 419 aa, Artificial Sequence; identical to SEQ ID NO: 84
  Synthetic Polypeptide

SEQ ID NO: 98 - protein, 419 aa, Artificial Sequence; identical to SEQ ID NO: 84
  Synthetic Polypeptide

SEQ ID NO: 99 - protein, 419 aa, Artificial Sequence; identical to SEQ ID NO: 84
  Synthetic Polypeptide

SEQ ID NO: 100 - protein, 419 aa, Artificial Sequence; identical to SEQ ID NO: 84
  Synthetic Polypeptide

SEQ ID NO: 101 - protein, 419 aa, Artificial Sequence; identical to SEQ ID NO: 84
  Synthetic Polypeptide

SEQ ID NO: 102 - protein, 419 aa, Artificial Sequence; identical to SEQ ID NO: 84
  Synthetic Polypeptide

SEQ ID NO: 103 - protein, 419 aa, Artificial Sequence; identical to SEQ ID NO: 84
  Synthetic Polypeptide

SEQ ID NO: 104 - protein, 419 aa, Artificial Sequence; identical to SEQ ID NO: 84
  Synthetic Polypeptide

SEQ ID NO: 105 - protein, 419 aa, Artificial Sequence; identical to SEQ ID NO: 84
  Synthetic Polypeptide

SEQ ID NO: 106 - protein, 419 aa, Artificial Sequence; identical to SEQ ID NO: 84
  Synthetic Polypeptide

SEQ ID NO: 107 - protein, 419 aa, Artificial Sequence; identical to SEQ ID NO: 84
  Synthetic Polypeptide

SEQ ID NO: 108 - protein, 419 aa, Artificial Sequence; identical to SEQ ID NO: 84
  Synthetic Polypeptide

SEQ ID NO: 109 - protein, 419 aa, Artificial Sequence; identical to SEQ ID NO: 84
  Synthetic Polypeptide

SEQ ID NO: 110 - protein, 419 aa, Artificial Sequence; identical to SEQ ID NO: 84
  Synthetic Polypeptide

SEQ ID NO: 111 - protein, 419 aa, Artificial Sequence; identical to SEQ ID NO: 84
  Synthetic Polypeptide

SEQ ID NO: 112 - protein, 419 aa, Artificial Sequence; identical to SEQ ID NO: 84
  Synthetic Polypeptide

SEQ ID NO: 113 - protein, 419 aa, Artificial Sequence; identical to SEQ ID NO: 84
  Synthetic Polypeptide

SEQ ID NO: 114 - protein, 419 aa, Artificial Sequence; identical to SEQ ID NO: 11
  Synthetic Polypeptide

SEQ ID NO: 115 - protein, 419 aa, Artificial Sequence; identical to SEQ ID NO: 11
  Synthetic Polypeptide

SEQ ID NO: 116 - protein, 419 aa, Artificial Sequence; identical to SEQ ID NO: 11
  Synthetic Polypeptide

SEQ ID NO: 117 - protein, 419 aa, Artificial Sequence; identical to SEQ ID NO: 11
  Synthetic Polypeptide

SEQ ID NO: 118 - protein, 419 aa, Artificial Sequence; identical to SEQ ID NO: 11
  Synthetic Polypeptide

SEQ ID NO: 119 - protein, 419 aa, Artificial Sequence; identical to SEQ ID NO: 11
  Synthetic Polypeptide

SEQ ID NO: 120 - protein, 419 aa, Artificial Sequence; identical to SEQ ID NO: 11
  Synthetic Polypeptide

SEQ ID NO: 121 - protein, 419 aa, Artificial Sequence; identical to SEQ ID NO: 11
  Synthetic Polypeptide

SEQ ID NO: 122 - protein, 419 aa, Artificial Sequence; identical to SEQ ID NO: 11
  Synthetic Polypeptide

SEQ ID NO: 123 - protein, 419 aa, Artificial Sequence; identical to SEQ ID NO: 11
  Synthetic Polypeptide

SEQ ID NO: 124 - protein, 419 aa, Artificial Sequence; identical to SEQ ID NO: 11
  Synthetic Polypeptide

SEQ ID NO: 125 - protein, 419 aa, Artificial Sequence; identical to SEQ ID NO: 11
  Synthetic Polypeptide

SEQ ID NO: 126 - protein, 419 aa, Artificial Sequence; identical to SEQ ID NO: 11
  Synthetic Polypeptide

SEQ ID NO: 127 - protein, 419 aa, Artificial Sequence; identical to SEQ ID NO: 11
  Synthetic Polypeptide

SEQ ID NO: 128 - protein, 419 aa, Artificial Sequence; identical to SEQ ID NO: 11
  Synthetic Polypeptide

SEQ ID NO: 129 - protein, 419 aa, Artificial Sequence; identical to SEQ ID NO: 11
  Synthetic Polypeptide

SEQ ID NO: 130 - protein, 419 aa, Artificial Sequence; identical to SEQ ID NO: 11
  Synthetic Polypeptide

SEQ ID NO: 131 - protein, 419 aa, Artificial Sequence; identical to SEQ ID NO: 11
  Synthetic Polypeptide

SEQ ID NO: 132 - protein, 419 aa, Artificial Sequence; identical to SEQ ID NO: 11
  Synthetic Polypeptide

SEQ ID NO: 133 - protein, 419 aa, Artificial Sequence; identical to SEQ ID NO: 11
  Synthetic Polypeptide

SEQ ID NO: 134 - protein, 411 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGQLYSALANKCCHVGCTKRSLARFCGSTDSGSDTSSGNSGDGNSGGSSGGGSGSSSGSSGSGGSGGSTDSGSDTSSGNSGDGNSGGSSGGGSGSSSGSSGSGGSGEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRK

SEQ ID NO: 135 - protein, 331 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGQLYSALANKCCHVGCTKRSLARFCEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRK

SEQ ID NO: 136 - protein, 351 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGQLYSALANKCCHVGCTKRSLARFCGSTDSGSDTSSGNSGDGNSGEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRK

SEQ ID NO: 137 - protein, 439 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFCGSTDSGSDTSSGNSGDGNSGEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRK

SEQ ID NO: 138 - protein, 439 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKREPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTKPPSRDELTKNQVSLSCLVKGFYPSDIAVEWESNGQPENNYKTTVPVLDSDGSFRLASYLTVDKSRWQQGNVFSCSVMHEALHNHYTQKSLSLSPGKRKGSTDSGSDTSSGNSGDGNSGQLYSALANKCCHVGCTKRSLARFC

SEQ ID NO: 139 - protein, 326 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKREVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCTKDPPRYHYTGLAVRGQGTTVTVSSGSTDSGSDTSSGNSGDGNSGQLYSALANKCCHVGCTKRSLARFC

SEQ ID NO: 140 - protein, 439 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKREPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRKGSTDSGSDTSSGNSGDGNSGQLYSALANKCCHVGCTKRSLARFC

SEQ ID NO: 141 - protein, 439 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFCGSTDSGSDTSSGNSGDGNSGEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTKPPSRDELTKNQVSLSCLVKGFYPSDIAVEWESNGQPENNYKTTVPVLDSDGSFRLASYLTVDKSRWQQGNVFSCSVMHEALHNHYTQKSLSLSPGKRK

SEQ ID NO: 142 - protein, 326 aa, Artificial Sequence
  Synthetic Polypeptide
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFCGSTDSGSDTSSGNSGDGNSGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCTKDPPRYHYTGLAVRGQGTTVTVSS

SEQ ID NO: 143 - protein, 439 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTKPPSRDELTKNQVSLSCLVKGFYPSDIAVEWESNGQPENNYKTTVPVLDSDGSFRLASYLTVDKSRWQQGNVFSCSVMHEALHNHYTQKSLSLSPGKRKKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 144 - protein, 238 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGQLYSALANKCCHVGCTKRSLARFCGSTDSGSDTSSGNSGDGNSGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCTKDPPRYHYTGLAVRGQGTTVTVSS

SEQ ID NO: 145 - protein, 351 aa, Artificial Sequence
  Synthetic Polypeptide
MPRLFFFHLLGVCLLLNQFSRAVADSWMEEVIKLCGRELVRAQIAICGMSTWSGSTDSGSDTSSGNSGDGNSGQLYSALANKCCHVGCTKRSLARFCGSTDSGSDTSSGNSGDGNSGEPKSSDKTHTSPPSPAPELLGGSSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTKPPSRDELTKNQVSLSCLVKGFYPSDIAVEWESNGQPENNYKTTVPVLDSDGSFRLASYLTVDKSRWQQGNVFSCSVMHEALHNHYTQKSLSLSPGKRK

SEQ ID NO: 146 - protein, 185 aa, Artificial Sequence; identical to SEQ ID NO: 1
  Synthetic Polypeptide

SEQ ID NO: 147 - protein, 308 aa, Artificial Sequence; identical to SEQ ID NO: 6
  Synthetic Polypeptide

SEQ ID NO: 148 - protein, 308 aa, Artificial Sequence; identical to SEQ ID NO: 6
  Synthetic Polypeptide

SEQ ID NO: 149 - protein, 308 aa, Artificial Sequence; identical to SEQ ID NO: 6
  Synthetic Polypeptide

SEQ ID NO: 150 - protein, 308 aa, Artificial Sequence; identical to SEQ ID NO: 6
  Synthetic Polypeptide

SEQ ID NO: 151 - protein, 308 aa, Artificial Sequence; identical to SEQ ID NO: 6
  Synthetic Polypeptide

SEQ ID NO: 152 - protein, 308 aa, Artificial Sequence; identical to SEQ ID NO: 6
  Synthetic Polypeptide

SEQ ID NO: 153 - protein, 308 aa, Artificial Sequence; identical to SEQ ID NO: 6
  Synthetic Polypeptide

SEQ ID NO: 154 - protein, 308 aa, Artificial Sequence; identical to SEQ ID NO: 6
  Synthetic Polypeptide

SEQ ID NO: 155 - protein, 308 aa, Artificial Sequence; identical to SEQ ID NO: 6
  Synthetic Polypeptide

SEQ ID NO: 156 - protein, 308 aa, Artificial Sequence; identical to SEQ ID NO: 6
  Synthetic Polypeptide

SEQ ID NO: 157 - protein, 308 aa, Artificial Sequence; identical to SEQ ID NO: 6
  Synthetic Polypeptide

SEQ ID NO: 158 - protein, 308 aa, Artificial Sequence; identical to SEQ ID NO: 6
  Synthetic Polypeptide

SEQ ID NO: 159 - protein, 308 aa, Artificial Sequence; identical to SEQ ID NO: 6
  Synthetic Polypeptide

SEQ ID NO: 160 - protein, 308 aa, Artificial Sequence; identical to SEQ ID NO: 6
  Synthetic Polypeptide

SEQ ID NO: 161 - protein, 308 aa, Artificial Sequence; identical to SEQ ID NO: 6
  Synthetic Polypeptide

SEQ ID NO: 162 - protein, 308 aa, Artificial Sequence; identical to SEQ ID NO: 6
  Synthetic Polypeptide

SEQ ID NO: 163 - DNA, 924 bp, Artificial Sequence
  Synthetic Polynucleotide
atgccccgcctgttcttcttccacctccttggcgtgtgcctcctcctcaaccagttcagccgggccgtggccgacagctggatggaggaggtcatcaagctctgcggccgcgagctcgtccgcgcccagatcgccatctgcggcatgtccacctggtccaagcgctccctctcccaggaggacgccccacagaccccgcgccccgtcgccgagatcgtcccctccttcatcaacaaggacaccgagacgatcaacatgatgtccgagttcgtcgccaacctgccgcaggagctcaagctcaccctctccgagatgcagcccgccctcccgcagctccagcagcacgtccccgtcctcaaggactcctccctcctcttcgaggagttcaagaagctcatccgcaaccgccagtccgaggccgccgactccagcccctccgagctgaagtacctcggcctcgacacccactcccgcaagaagcgccagctctactccgccctcgccaacaagtgctgccacgtcggctgcaccaagcggtccctggcccgcttctgcggaggcggcggctctggcggtggtggatccggcggcggtggcagcgacatccagatgacccagtccccatccagcctgagcgcctccgtcggcgaccgcgtcaccatcacctgccgcgcctcccgccccatcggcaccatgctctcctggtaccagcagaagcccggcaaggccccgaagctcctcatcctcgccttctcccgcctccagtccggcgtcccgtcaaggttctccggctcgggctccggtaccgacttcaccctcaccatctcctcgctccagccagaggacttcgccacctactactgcgcccaggccggcacccaccccaccaccttcggccagggcaccaaggtcgagatcaagcgc

SEQ ID NO: 164 - DNA, 924 bp, Artificial Sequence
  Synthetic Polynucleotide
atgcccagactgttcttcttccacctcctcggcgtgtgcctcctccttaaccagttcagccgggccgtggccgacagctggatggaggaggtgatcaagctatgcggccgggagctcgtgcgggcccagatcgccatctgcggcatgagcacctggagcaagcggagcctgagccaggaggacgcccctcagaccccgcggccagtggccgagatcgtgcccagcttcatcaacaaggacaccgagacaatcaacatgatgagcgagttcgtggccaacctgccccaggagctgaagctgaccctgagcgagatgcagcccgccctgccgcagctgcagcagcacgtgcccgtgctgaaggacagcagcctgctgttcgaggagttcaagaagctgatccggaaccggcagagcgaggccgccgactccagccccagcgaactgaagtacctgggcctggacacccacagccggaagaagcggcagctgtacagcgccctggccaacaagtgctgccacgtgggctgcaccaagcgatccctggcccggttctgcggcggcggaggcagcggcggtggcggaagcggaggcggcggcagcgacatccagatgacccagagcccaagctccctgtccgccagcgtgggcgaccgggtgaccatcacctgccgggccagccggcccatcggcaccatgctgagctggtaccagcagaagcccggcaaggccccgaagctgctgatcctggccttctccaggctgcagagcggcgtgccgagccggttcagcggctccggcagcggaaccgacttcaccctgaccatctcaagcctgcagccggaggacttcgccacctactactgcgcccaggccggcacccaccccaccaccttcggccagggcaccaaggtggagatcaagcgg

SEQ ID NO: 165 - DNA, 555 bp, Artificial Sequence; identical to SEQ ID NO: 2
  Synthetic Polynucleotide

SEQ ID NO: 166 - DNA, 519 bp, Artificial Sequence
  Synthetic Polynucleotide
atgcctaggctctttttcttccacttgctaggggtgtgcttgttgttaaaccagtttagtagagcggtcgccgattcttggatggaggaagtgataaagctctgtgggcgggaattagtccgcgcacaaattgccatatgcggaatgggtgggggcggtagtggcggaggaggttccgggggaggagggagcggcggaggaggctcaggcggcggaggaagtggtggcggtggctcaggtggcggaggatctgggggcggcggaagcggcggaggaggatctgggggcggtggaagtggcggaggtgggtctggcgggggagggagtggcgggggcggttccgggggtggaggcagcggaggcggtggctccggggggggtggttccggtggtggcgggtcaggaggaggggggtcaggcggcggaggatccggcggcggcggctcccaactttattcggctctggctaataaatgctgtcacgtgggctgcaccaaacgttcgcttgcgcggttttgt

SEQ ID NO: 167 - DNA, 519 bp, Artificial Sequence
  Synthetic Polynucleotide
atgcctcgactgtttttctttcacctcctaggagtctgcttacttctcaaccagttcagtagggcagtcgcggactcatggatggaagaggttattaaattatgtggccgtgaattggtgcgtgcacaaatagctatttgcggcatgggcggtggcggctctggtggcggcggctctggagggggcggaagtggtggaggaggtagtggcggaggtggatcgggaggcggaggatctggaggggggggctcctttcaaagctcctcgagcaaagcgccccctcccagcctgcccagccctagtaggctgcccggtccgagcgacacgcccatcctgccccagggtggcggtggctctgggggtggcggttcaggcggaggtggttctggcggaggcggatcaggtggtgggggatccggcggcggcggatctggtggcggggggagtcagctctactctgcgttggccaataaatgctgccatgttggttgtacaaaaagatctttggctagattttgc

SEQ ID NO: 168 - DNA, 1257 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatggagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaagagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 169 - DNA, 555 bp, Artificial Sequence
  Synthetic Polynucleotide
atgcccaggctgttcttcttccacctgctgggagtgtgcctcctgctgaaccagttcagccgcgccgtggccgacagctggatggaggaggtgatcaagctgtgcgggagggagctggtccgagcccaaatcgccatctgcgggatgtccacctggagcaagagaagcctgtcccaggaggatgccccccaaacgcccaggcccgtggccgagatcgtgcccagcttcatcaacaaggacaccgagaccatcaacatgatgtccgagttcgtggccaacctgccccaggagctgaagctgaccctgtccgagatgcagccagccctcccccagctgcagcagcacgtgcccgtgttgaaggacagcagcctgctgttcgaggagttcaaaaagctgatacgcaacaggcagagcgaggcggccgacagctccccgtcggagctgaagtacctggggctggacacccacagccggaagaagcggcagctgtacagcgcactggccaacaaatgttgccacgtgggctgcaccaagaggagcctggccaggttctgc

SEQ ID NO: 170 - DNA, 555 bp, Artificial Sequence
  Synthetic Polynucleotide
atgcccaggctgttcttcttccacctcctgggtgtgtgcctgctgctgaaccagtttagcagggccgtggccgacagctggatggaggaggtgatcaagctgtgcggcagggagctcgtgcgagcgcagatcgccatctgcggcatgagcacctggagtaagaggagcctctcccaggaggacgccccccagacgccacgcccggtggcggagatcgtgccctccttcatcaacaaggacacagagaccatcaacatgatgagcgagtttgtggccaacctgccccaggaacttaagctgaccctcagcgagatgcagccggcccttccccagctgcagcagcacgtgcccgtgctgaaggacagcagcctgctgttcgaggagttcaaaaagctgatccgcaataggcagagcgaggccgccgactccagccccagcgagctgaagtatctgggcctggacacccacagcaggaagaaacggcagctgtacagcgcgctggcgaacaagtgctgccacgtgggctgcaccaagaggtcgctcgccaggttctgc

SEQ ID NO: 171 - DNA, 555 bp, Artificial Sequence
  Synthetic Polynucleotide
atgcccaggctgttcttctttcacctgctgggcgtgtgtctgctgctcaaccagtttagccgcgccgtggccgacagctggatggaggaggtcataaagctgtgcgggagggaactggtgagggcccagatcgccatctgcggaatgtccacctggagcaagaggagcctgagccaggaggacgccccacagactccgcggccggttgcggagatcgtgccctccttcatcaataaagataccgagaccatcaacatgatgtccgagttcgtggccaacctgccgcaggagctgaaactcaccctcagcgagatgcagcccgcgctgccccagctgcagcagcacgtgcccgtgctgaaggacagcagcctgctgtttgaagaattcaaaaaactgatccggaaccgacagagcgaggccgccgactccagccccagcgaactgaagtacctggggctggacacccacagccggaaaaagcggcagctgtacagcgcactggccaataagtgttgccacgtcggctgcacgaagcggtcccttgcccgcttctgc

SEQ ID NO: 172 - DNA, 555 bp, Artificial Sequence
  Synthetic Polynucleotide
atgccccgcctgttcttctttcacctgctgggcgtgtgcctgctgctgaaccagttcagcagggccgtggccgacagctggatggaagaggtgatcaagctctgcggcagggaactggtgagggcccagatcgccatctgcggcatgtccacctggtccaaaaggagcctcagccaggaggacgccccccagaccccccggccagtggccgagatcgtgccctccttcatcaacaaggacaccgagactatcaacatgatgtccgagttcgtggccaacctgccccaggagctgaagctgaccctgagcgaaatgcagcccgcgctgccccagctgcaacagcacgtgcccgtgctgaaggacagcagcctgctgtttgaggagttcaagaagctgatccgcaacaggcagagcgaggccgccgactccagccccagcgaactgaaatatctggggctggacacccactcccggaagaagaggcagctgtacagcgccctggccaacaaatgctgccacgtggggtgcacgaagcggtccctggcccgcttttgc

SEQ ID NO: 173 - DNA, 555 bp, Artificial Sequence
  Synthetic Polynucleotide
atgcccaggctgtttttcttccacctcctgggcgtgtgcctgctgctgaatcagttttcccgggccgtggccgacagctggatggaggaggtgatcaagctgtgtggccgggagctggttcgggcccagatagccatctgtggaatgagcacctggagcaagcggagcctgtcccaggaggacgccccccagacaccccggccggtggccgaaatcgtccccagcttcatcaacaaggacaccgagaccatcaacatgatgagcgagttcgtggccaacctgccccaggagctgaagctgacgctgagcgagatgcagcctgccctgccccagctgcaacagcacgtgcctgtgctgaaggacagcagcctcctgttcgaggagttcaagaagctcatcaggaaccggcagagcgaggccgctgacagctcacccagcgagctgaagtacctgggcctggacacccactcgaggaagaagcggcagctgtacagcgcgctggccaacaagtgttgccatgtgggctgtaccaagaggagcctggccaggttctgc

SEQ ID NO: 174 - DNA, 555 bp, Artificial Sequence
  Synthetic Polynucleotide
atgccccgactgttctttttccacctgctgggggtgtgcctgctgctgaaccagttttcgagggcggtggcggacagttggatggaggaggtcatcaagctctgcgggagggagctcgtcagggcccagatcgccatctgcggcatgtccacctggagcaagcgttcgctgtcccaggaggacgccccccagaccccgagacccgtggccgagatcgtgcccagcttcatcaacaaggataccgaaaccatcaacatgatgagcgagtttgtggccaacctcccgcaggagctcaagctcacgctgagcgagatgcagccggccctgccccagctgcagcagcatgtccccgtcctgaaggacagcagcctgctgttcgaggagttcaagaaactgatccggaaccggcagagcgaggccgccgatagcagccccagcgagctgaagtacctggggctggacacccacagtcgcaagaagcggcagctgtacagcgccctggccaacaagtgttgccacgtcgggtgtacgaagcgctccctggccagattctgc

SEQ ID NO: 175 - DNA, 555 bp, Artificial Sequence
  Synthetic Polynucleotide
atgccccggctgttctttttccacctgctgggcgtgtgcctgctgctgaaccagttcagccgagccgtcgcagattcctggatggaggaggtgatcaagctgtgcggccgggagctcgtgagggcccagatcgccatttgcggcatgtccacctggagcaagcggagcctgagccaggaggacgcgccgcagactccccggcccgtggccgaaatcgtgccctccttcatcaataaggacaccgaaaccataaacatgatgagcgagtttgtggccaacctgccacaggagctgaaactgacgctgagcgagatgcagcccgcgctgccccagctgcagcagcatgtgcccgtgctgaaggacagcagcctgctgttcgaggaatttaagaagctaatccggaacaggcagagcgaggccgccgacagctccccgagcgagctgaagtacctcgggctggacacccacagccggaagaagcggcaactgtacagcgccctggcgaacaagtgctgccacgtgggctgtaccaaaagaagcctcgcccgcttctgc

SEQ ID NO: 176 - DNA, 555 bp, Artificial Sequence
  Synthetic Polynucleotide
atgcctaggctcttcttcttccacctgctgggcgtctgcctgctgctgaaccaattcagccgggccgtagccgactcctggatggaggaggtgatcaaactgtgcgggagggagctggtgagggcccaaatcgcgatctgcggcatgtccacctggagcaagcggagcctgtcgcaggaagatgccccccagacccccaggccggtggccgagatcgtccccagcttcatcaacaaggataccgagaccataaacatgatgagcgagtttgtggccaacctcccccaggagctgaagctgaccctcagcgagatgcagcccgccctgccgcagctgcaacagcacgtgcccgtgctgaaggacagcagcctgctgttcgaagagttcaagaagctgatccggaaccggcagagcgaggccgccgacagctccccctccgagctgaagtacctgggcctggacacgcacagccggaagaagcggcagctgtacagcgcactggccaacaagtgctgtcacgtcggctgcaccaagcgtagcctggccagattctgc

SEQ ID NO: 177 - DNA, 555 bp, Artificial Sequence
  Synthetic Polynucleotide
atgcccaggctgttcttcttccacctgctgggcgtgtgcctgctgctcaaccagttcagcagggccgtggccgacagctggatggaggaggtgatcaaactgtgcgggagggagctggtgagggcgcagatcgccatctgcggcatgagcacctggagcaagaggagcctcagccaggaggacgccccccagacccccaggcccgtggccgagatcgtgcccagcttcatcaacaaggacaccgaaaccatcaacatgatgagcgagttcgtggccaacctgccccaggagctcaagctgaccctcagcgagatgcaacccgccctgccccagctgcagcagcacgtgcccgtgctgaaggacagcagcctgctgttcgaggagttcaagaagctgatccgtaacaggcagagcgaggccgccgactccagccccagcgagctgaagtacctgggcctggacacccactcccggaagaagaggcagctgtacagtgcgctggccaacaaatgttgccatgtgggctgcaccaagcggagcctggcccgcttctgc

SEQ ID NO: 178 - DNA, 555 bp, Artificial Sequence
  Synthetic Polynucleotide
atgcccaggctgttctttttccacctgctgggggtctgcctcctgctgaaccagttctccagggcggtcgccgacagctggatggaagaggtcatcaagctgtgcgggagggagctggtcagggcccagatcgccatctgtggcatgtccacctggagcaagaggagcctgagccaggaggacgcgccgcagacgccccgtcccgtggcggagatagtgccgagcttcatcaacaaggacaccgagactatcaacatgatgagcgagttcgtggccaacctccctcaggagctgaagctgaccctgagcgagatgcagcccgccctcccccagctgcaacagcacgtgcccgtgctgaaggacagcagcctcctgttcgaggagttcaagaagctgatccggaataggcagagcgaggccgccgatagctcgcccagcgagcttaagtacctgggcctcgacacacacagcaggaagaagaggcagctgtacagcgccctggccaacaagtgttgccacgtcggctgcactaagcggagcctcgctaggttctgc

SEQ ID NO: 179 - DNA, 555 bp, Artificial Sequence
  Synthetic Polynucleotide
atgccccgactgttcttcttccatctgctgggcgtgtgcctcctgctgaatcaattcagcagggccgtggccgactcctggatggaggaggtcatcaagctgtgcggcagggaactggtgagggcgcagatcgccatctgcggcatgtccacttggagcaagaggtcgctgtcgcaggaggacgccccccagaccccgaggcccgtggccgagatcgtgcccagcttcatcaacaaggacaccgagaccatcaatatgatgtccgagttcgtggccaacctccctcaggagctgaagctgaccctgtccgagatgcagcccgccctgccgcagcttcagcagcacgtgcccgtgctgaaggacagcagcctgctgttcgaggaattcaagaagctgattaggaacaggcaaagcgaggccgccgactccagcccgagcgagctgaagtacctgggcctcgacacccatagccgcaagaagcggcagctgtactcggccctggcgaacaagtgctgccacgtgggctgcaccaagcgcagcctggcgcgcttctgc

SEQ ID NO: 180 - DNA, 555 bp, Artificial Sequence
  Synthetic Polynucleotide
atgcccaggctgtttttcttccacctgctgggggtctgcctgctgctgaaccagtttagcagggccgtggccgacagctggatggaggaggtgatcaagctgtgcggcagggagctggtgcgggcccagatcgccatctgcggcatgagcacctggagcaagcggtccctgagccaggaggacgccccccagactccccggccggtggccgaaatcgtgcccagcttcatcaacaaggacaccgagaccatcaatatgatgtccgagttcgtggccaacctgccccaggagctgaaactgaccctgagcgagatgcagcccgccctgccccagctgcagcagcatgtccccgtgctgaaggacagcagcctgttgtttgaggagttcaaaaaactgatccgaaacaggcagtcggaggccgctgacagctcgccaagcgagctgaagtatctggggctggacacccacagccgcaagaagaggcagctgtatagcgcgctggccaacaagtgctgccacgtgggctgcacgaagaggtccctggccaggttctgc

SEQ ID NO: 181 - DNA, 555 bp, Artificial Sequence
  Synthetic Polynucleotide
atgcccaggctgttcttcttccacctgctgggcgtgtgcctgctgctgaaccagttcagcagggccgtggccgacagctggatggaggaggtgatcaagctgtgcggccgggagctcgtgagggcccagatcgcgatctgcggcatgagcacctggagcaaaaggagtctgagccaggaggacgcgccgcagacgcccaggcccgtcgccgagatcgtgccgtccttcatcaacaaggacaccgagaccatcaatatgatgagcgagttcgtggccaacctgccccaggagctcaagctgaccctgagcgagatgcagcccgcgctgccccagctgcagcagcacgtgcccgtgctgaaggactccagcctgctgttcgaggagttcaagaaactgatcagaaacaggcagagcgaggccgccgactccagcccctcagagctgaagtacctgggcctggacacccacagcaggaagaagcgccagctctacagcgccctggccaacaagtgctgccacgtcgggtgcacaaagaggagcctggccaggttctgc

SEQ ID NO: 182 - DNA, 555 bp, Artificial Sequence
  Synthetic Polynucleotide
atgccccggctgttcttcttccacctgctgggcgtgtgcctcctgctgaaccagttcagcagggccgtggccgacagctggatggaggaggtgatcaagctgtgcggcagggagctggtgagggcgcagatcgccatctgcggcatgagcacctggagcaagaggagcctgagccaggaggacgccccgcaaaccccccggccggtcgcggagatagtgcccagcttcataaacaaggacaccgagaccatcaatatgatgagcgagttcgtggccaacctgccccaggagctgaagctgacgctgagcgagatgcagccggccctgccgcagctgcagcagcacgtgcccgtgctgaaggacagcagcctcctgttcgaggagttcaagaagctgatcaggaaccggcagagcgaggccgccgactccagccccagcgagctgaagtacctgggcctggacacccatagcaggaagaagcgccagctgtacagcgccctggctaacaagtgctgccacgtgggctgcaccaagaggagcctggcccggttctgc

SEQ ID NO: 183 - DNA, 555 bp, Artificial Sequence
  Synthetic Polynucleotide
atgccccggctgttcttcttccacctgctcggcgtgtgcctgctgctgaaccaattcagccgggccgtcgccgacagctggatggaggaggtgatcaagctgtgcggcagggagctggtcagggcccagatcgccatctgtgggatgtcgacctggtccaagcgcagcctgagccaggaggacgccccgcagaccccaagacccgtggccgagatcgtgcccagcttcatcaacaaagataccgagaccatcaacatgatgagcgagttcgtggccaacctcccccaggagctgaagctgaccctcagcgagatgcagcccgcgctgccccagctgcagcagcacgtgcccgtgctgaaggacagctccctgctgttcgaggagttcaagaagctgatccggaacaggcagtccgaggccgccgacagcagcccgagcgagctgaagtacctggggctggacacccacagcaggaagaagcggcagctgtacagcgccctggccaacaagtgctgccacgtgggctgtaccaaacgcagcctcgccaggttctgc

SEQ ID NO: 184 - DNA, 555 bp, Artificial Sequence
  Synthetic Polynucleotide
atgcccaggctgttcttcttccacctgctgggggtctgtctcctgctgaaccagttcagccgggccgtggccgactcctggatggaggaggtgatcaagctgtgcgggcgggagctggtgcgggcgcagatcgccatctgcggcatgtcaacctggtccaaaaggtccctcagccaggaagacgccccccagacccccaggcccgtggccgaaatcgtgcccagctttatcaacaaggacaccgagaccatcaacatgatgagcgagtttgtggccaacctcccccaggagctgaagctgaccctgagcgagatgcagcccgcgctgccccaactgcagcagcacgtgccggtgctgaaggactcgagcctgctgttcgaggagttcaagaagctcatcaggaacaggcagagcgaggccgccgattcgagccccagcgagctcaagtacctggggctggacactcacagccggaagaagcggcagctgtacagcgccctggcgaacaagtgttgccacgtgggctgcaccaagaggagcctggccaggttctgt

SEQ ID NO: 185 - DNA, 555 bp, Artificial Sequence
  Synthetic Polynucleotide
atgcccaggctgttctttttccacctcctgggggtgtgtctgctcctgaaccagttcagcagggccgtggccgattcctggatggaggaggtcatcaagctgtgtggaagggagctggtgagggcccagatcgccatctgcgggatgtccacctggagcaagcggagcctgtcccaggaggacgccccgcagacccccaggccggtggcggagatcgtccccagcttcatcaacaaggacaccgagaccatcaacatgatgagcgagttcgtggccaacctgccccaggaactgaagctcaccctgagtgagatgcagcccgccctgccccagctgcagcagcatgtgcccgtgctgaaggacagcagcctgctcttcgaggagttcaagaagctgatcaggaacaggcagagcgaggccgccgacagctccccctccgagctgaagtaccttggactggacacccacagccggaagaagcggcaactgtactccgccctggccaacaagtgctgccacgtgggctgtacgaagaggagcctggccaggttctgc

SEQ ID NO: 186 - DNA, 555 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcggccgggagctggtgcgggcccagatcgccatctgcggcatgagcacctggagcaagcggagcctgagccaggaggacgccccccagaccccccggcccgtggccgagatcgtgcccagcttcatcaacaaggacaccgagaccatcaacatgatgagcgagttcgtggccaacctgccccaggagctgaagctgaccctgagcgagatgcagcccgccctgccccagctgcagcagcacgtgcccgtgctgaaggacagcagcctgctgttcgaggagttcaagaagctgatccggaaccggcagagcgaggccgccgacagcagccccagcgagctgaagtacctgggcctggacacccacagccggaagaagcggcagctgtacagcgccctggccaacaagtgctgccacgtgggctgcaccaagcggagcctggcccggttctgc

SEQ ID NO: 187 - DNA, 555 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcgggagggagctggtgagggcgcagatcgcgatctgcgggatgagcacgtggagcaagaggagcctgagccaggaggacgcgccgcagacgccgaggccggtggcggagatcgtgccgagcttcatcaacaaggacacggagacgatcaacatgatgagcgagttcgtggcgaacctgccgcaggagctgaagctgacgctgagcgagatgcagccggcgctgccgcagctgcagcagcacgtgccggtgctgaaggacagcagcctgctgttcgaggagttcaagaagctgatcaggaacaggcagagcgaggcggcggacagcagcccgagcgagctgaagtacctggggctggacacgcacagcaggaagaagaggcagctgtacagcgcgctggcgaacaagtgctgccacgtggggtgcacgaagaggagcctggcgaggttctgc

SEQ ID NO: 188 - DNA, 555 bp, Artificial Sequence
  Synthetic Polynucleotide
atgccccggctgttcttcttccacctgctgggcgtgtgcctgctgctgaaccagttcagccgggccgtggccgacagctggatggaggaggtcatcaagctctgcggccgcgagctcgtccgcgcccagatcgccatctgcggcatgtccacctggtccaagcgctccctctcccaggaggacgccccccagaccccccgccccgtcgccgagatcgtcccctccttcatcaacaaggacaccgagaccatcaacatgatgtccgagttcgtcgccaacctcccccaggagctcaagctcaccctctccgagatgcagcccgccctcccccagctccagcagcacgtccccgtcctcaaggactcctccctcctcttcgaggagttcaagaagctcatccgcaaccgccagtccgaggccgccgactcctccccctccgagctcaagtacctcggcctcgacacccactcccgcaagaagcgccagctctactccgccctcgccaacaagtgctgccacgtcggctgcaccaagcgctccctcgcccgcttctgc

SEQ ID NO: 189 - DNA, 276 bp, Artificial Sequence
  Synthetic Polynucleotide
atgccccggctgttctttttccacctgctgggcgtgtgcctgctgctgaaccagttttctagggccgtggccgacagctggatggaggaagtgatcaagctgtgcggccgggagctggtgagagcacagatcgccatctgtggcatgtccacctggagcggctccaacggctctaccaacgattctaatggcagcacaggctcccagctgtacagcgccctggccaataagtgctgtcacgtgggctgcacaaagaggtccctggcccgcttctgt

SEQ ID NO: 190 - DNA, 276 bp, Artificial Sequence
  Synthetic Polynucleotide
atgccccggctgttctttttccacctgctgggcgtgtgcctgctgctgaaccagttttctagggccgtggccgacagctggatggaggaagtgatcaagctgtgcggccgggagctggtgagagcacagatcgccatctgtggcatgtccacctggagcggctccaacggctctaccaacacctctaatggcgacacaggctcccagctgtacagcgccctggccaataagtgctgtcacgtgggctgcacaaagaggtccctggcccgcttctgt

SEQ ID NO: 191 - DNA, 276 bp, Artificial Sequence
  Synthetic Polynucleotide
atgccccggctgttctttttccacctgctgggcgtgtgcctgctgctgaaccagttttctagggccgtggccgacagctggatggaggaagtgatcaagctgtgcggccgggagctggtgagagcacagatcgccatctgtggcatgtccacctggagcggctccaacggcaagaccaacacctctaatggcgacacaggctcccagctgtacagcgccctggccaataagtgctgtcacgtgggctgcacaaagaggtccctggcccgcttctgt

SEQ ID NO: 192 - DNA, 291 bp, Artificial Sequence
  Synthetic Polynucleotide
atgccccggctgttctttttccacctgctgggcgtgtgcctgctgctgaaccagttttccagggccgtggccgactcttggatggaggaagtgatcaagctgtgcggccgggagctggtgagagcacagatcgccatctgtggcatgtctacctggtctggcagcacaaactccggctctaccagctccggcaacagcggctccggcaattctggcagccagctgtacagcgccctggccaataagtgctgtcacgtgggctgcacaaagaggtccctggcccgcttctgt

SEQ ID NO: 193 - DNA, 291 bp, Artificial Sequence
  Synthetic Polynucleotide
atgccccggctgttctttttccacctgctgggcgtgtgcctgctgctgaaccagttttccagggccgtggccgactcttggatggaggaagtgatcaagctgtgcggccgggagctggtgagagcacagatcgccatctgtggcatgagcacctggtctggcagcacaaactccggctctgataccagctccggcaacagcggctccggcaattctggccagctgtacagcgccctggccaataagtgctgtcacgtgggctgcacaaagaggtccctggcccgcttctgt

SEQ ID NO: 194 - DNA, 291 bp, Artificial Sequence
  Synthetic Polynucleotide
atgccccggctgttctttttccacctgctgggcgtgtgcctgctgctgaaccagttttctagggccgtggccgacagctggatggaggaagtgatcaagctgtgcggccgggagctggtgagagcacagatcgccatctgtggcatgtccacctggagcggctccacaaactctggcagcgataccggctctggcaactccaagtctggcaatagcggccagctgtactccgccctggccaataagtgctgtcacgtgggctgcacaaagaggagcctggcccgcttctgt

SEQ ID NO: 195 - DNA, 291 bp, Artificial Sequence
  Synthetic Polynucleotide
atgccccggctgttctttttccacctgctgggcgtgtgcctgctgctgaaccagttttctagggccgtggccgacagctggatggaggaagtgatcaagctgtgcggccgggagctggtgagagcacagatcgccatctgtggcatgtccacctggagcggctccacaaactctggcagcgacacctccggcaagaactctggcgatggcaatagcggccagctgtactccgccctggccaataagtgctgtcacgtgggatgcacaaagcggagcctggcccgcttctgt

SEQ ID NO: 196 - DNA, 291 bp, Artificial Sequence
  Synthetic Polynucleotide
atgccccggctgttctttttccacctgctgggcgtgtgcctgctgctgaaccagtttagcagggccgtggcagactcctggatggaggaagtgatcaagctgtgcggccgggagctggtgagagcacagatcgccatctgtggcatgtctacctggtctggcagcacagactccggctctgataccagctccggcaacagcggcgatggcaattccggccagctgtactctgccctggccaataagtgctgtcacgtgggctgcacaaagaggagcctggcccgcttctgt

SEQ ID NO: 197 - DNA, 321 bp, Artificial Sequence
  Synthetic Polynucleotide
atgccccggctgttctttttccacctgctgggcgtgtgcctgctgctgaaccagttttccagggccgtggccgactcttggatggaggaagtgatcaagctgtgcggccgggagctggtgagagcacagatcgccatctgtggcatgtctacctggagcggcagctccggctctacaaacgattccaatggctctaccggcacaggcagcgacggctccaccaacggctctgatggcagcacaggaggacagctgtacagcgccctggccaataagtgctgtcacgtgggatgcaccaagaggtccctggcccgcttctgt

SEQ ID NO: 198 - DNA, 381 bp, Artificial Sequence
  Synthetic Polynucleotide
atgccccggctgttctttttccacctgctgggcgtgtgcctgctgctgaaccagtttagcagggccgtggcagactcctggatggaggaagtgatcaagctgtgcggccgggagctggtgagagcacagatcgccatctgtggcatgagcacctggtccggctctacaaacagcggctccgacaccagctccggctccacaaattctggcagcgatacctctagcggcaactccggctctggcaatagcggctccaagggcaccggctctgatggcagcacaaacggctccaatggctctaccggaggacagctgtactctgccctggccaataagtgctgtcacgtgggctgcacaaagaggtccctggcccgcttctgt

SEQ ID NO: 199 - DNA, 1341 bp, Artificial Sequence
  Synthetic Polynucleotide
atgcccaggctgttctttttccacctgctgggcgtgtgcctgctgctgaaccagttttcccgcgccgtggcagactcttggatggaggaagtgatcaagctgtgcggccgggagctggtgagagcacagatcgccatctgtggcatgtctacctggagcaagcggtccctgtctcaggaggacgcccctcagacacctagaccagtggccgagatcgtgcccagcttcatcaacaaggataccgagacaatcaatatgatgtccgagttcgtggccaatctgcctcaggagctgaagctgaccctgtccgagatgcagccagccctgccacagctgcagcagcacgtgccagtgctgaaggatagctccctgctgtttgaggagttcaagaagctgatccggaacagacagtccgaggccgccgactctagcccttctgagctgaagtacctgggcctggatacccacagcaggaagaagcgccagctgtattccgccctggccaataagtgctgtcacgtgggctgcacaaagaggtccctggcccgcttttgtggcggcggcggctctggaggaggaggcagcggcggaggaggcagcatggtgcggtccgtggagtgcccaccttgtccagcaccaccagtggcaggccctagcgtgtttctgttccctccaaagccaaaggacaccctgatgatctctaggacccccgaggtgacatgcgtggtggtggacgtgagccacgaggaccccgaggtgcagttcaactggtacgtggatggcatggaggtgcacaatgccaagacaaagccccgggaggagcagtttaacagcaccttcagagtggtgtccgtgctgacagtggtgcaccaggactggctgaacggcaaggagtataagtgcgccgtgtccaataagggcctgccagcacctatcgagaagaccatctctaagacaaagggccagcctagggagccacaggtgtacaccctgcccccttcccgcgaggagatgaccaagaaccaggtgtctctgacatgtctggtgaagggcttttatccctctgacatcgccgtggagtgggagagcaatggccagcctgagaacaattacaagaccacaccacccatgctggactccgatggcagcttcttcctgtattctaagctgacagtggataagagccggtggcagcagggcaacgtgttcagctgttccgtgatgcacgaggccctgcacaatcactacacccagaagtctctgagcctgtcccccggcaagggcaagccaatccccaatcctctgctgggcctggatagcacacaccaccaccaccaccac

SEQ ID NO: 200 - DNA, 984 bp, Artificial Sequence
  Synthetic Polynucleotide
atgcctaggctgttctttttccacctgctgggcgtgtgcctgctgctgaaccagttttctcgcgccgtggcagacagctggatggaggaagtgatcaagctgtgcggccgggagctggtgcgcgcacagatcgccatctgtggcatgagcacctggtccaagcggagcctgagccaggaggacgcaccacagacacccagacctgtggccgagatcgtgccttcctttatcaacaaggataccgagacaatcaatatgatgtctgagttcgtggccaatctgccccaggagctgaagctgaccctgtccgagatgcagccagccctgccacagctgcagcagcacgtgcctgtgctgaaggatagctccctgctgtttgaggagttcaagaagctgatccggaacagacagtccgaggccgccgactctagcccatctgagctgaagtacctgggcctggatacccacagcaggaagaagcgccagctgtattccgccctggccaataagtgctgtcacgtgggctgcacaaagcggtccctggccagattttgtggcggcggcggctctggaggaggaggcagcggcggaggaggctccgacatccagatgacccagagcccttcctctctgtccgcctctgtgggcgatcgggtgaccatcacatgcagggccagccggcccatcggcacaatgctgagctggtatcagcagaagcctggcaaggccccaaagctgctgatcctggccttctctaggctgcagagcggcgtgccctcccgctttagcggctccggctctggcaccgacttcaccctgacaatcagctccctgcagccagaggattttgccacctactattgtgcccaggccggcacacaccccaccacattcggccagggcaccaaggtggagatcaagaggggcaagccaatccccaaccctctgctgggcctggacagcacacaccaccaccaccaccac

SEQ ID NO: 201 - DNA, 291 bp, Artificial Sequence
  Synthetic Polynucleotide
atgcctcgactgttctttttccacctgctgggcgtgtgcctgctgctgaatcagtttagccgggccgtcgccgatagttggatggaggaagtgatcaagctgtgcggccgggagctggtgagagcacagatcgccatctgtggcatgtccacctggtctggcagctccggaggaggctctggctctagctccggctctagcggcagcggcggctccggccagctgtacagcgctctggctaataagtgttgtcacgtcggatgtactaaacgaagtctggctagattttgc

SEQ ID NO: 202 - DNA, 555 bp, Artificial Sequence; identical to SEQ ID NO: 2
  Synthetic Polynucleotide

SEQ ID NO: 203 - DNA, 534 bp, Artificial Sequence
  Synthetic Polynucleotide
atgggcgtgaaagtgctgtttgcgctgatttgcattgcggtggcggaagcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 204 - DNA, 1236 bp, Artificial Sequence
  Synthetic Polynucleotide
atgggcgtgaaagtgctgtttgcgctgatttgcattgcggtggcggaagcggactcatggatggaggaagttattaaattatgcggccgcgaattagttcgcgcgcagattgccatttgcggcatggagcccaagagcagcgacaagacccacaccagcccccccagccccgcccccgagctgctgggcggcagcagcgtgttcctgttcccccccaagcccaaggacaccctctacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagacaaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaagagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 205 - DNA, 498 bp, Artificial Sequence
  Synthetic Polynucleotide
atgggcgtgaaagtgctgtttgcgctgatttgcattgcggtggcggaagcggactcatggatggaagaggttattaaattatgtggccgtgaattggtgcgtgcacaaatagctatttgcggcatgggcggtggcggctctggtggcggcggctctggagggggcggaagtggtggaggaggtagtggcggaggtggatcgggaggcggaggatctggaggggggggctcctttcaaagctcctcgagcaaagcgccccctcccagcctgcccagccctagtaggctgcccggtccgagcgacacgcccatcctgccccagggtggcggtggctctgggggtggcggttcaggcggaggtggttctggcggaggcggatcaggtggtgggggatccggcggcggcggatctggtggcggggggagtcagctctactctgcgttggccaataaatgctgccatgttggttgtacaaaaagatctttggctagattttgc

SEQ ID NO: 206 - DNA, 1236 bp, Artificial Sequence
  Synthetic Polynucleotide
atgggcgtgaaggtgctgttcgcactgatctgcatcgccgtggccgaggccgacagctggatggaggaggtgatcaagctgtgcggcagagagctggtgagagcccagatcgccatctgcggcatgagcacctggagcgagcccaagagcagcgacaagacccacaccagcccccccagccccgctcccgagctgctgggcggcagcagcgtgttcctgttcccccccaagcccaaggacaccctgtacataaccagagagccagaggtgacctgcgtggtggtggacgtgagccacgaggaccccgaggtgaagttcaactggtacgtggacggcgtggaggtgcacaacgccaagacaaagcccagagaggagcagtacaacagcacctacagagtggtgagcgtgctgaccgtgctgcaccaggactggctgaacggcaaggagtataagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccttacacaaccactacacccagaagagcctaagcctgagccccggcaagagaaagaagagaagtctgagccaggaggacgccccccagacccccagacccgtggccgagatcgtgccctccttcattaacaaggacaccgagaccatcaacatgatgagcgagttcgtggccaacctgccccaggagctgaagctgaccctgagcgaaatgcaacccgccctgccccagctgcaacagcacgtgcccgtgctgaaggacagcagcctgctgttcgaggagttcaaaaagctgatcagaaacagacagagcgaggccgccgactccagccccagcgagctgaagtacctgggcctggacacccacagcagaaagaagagacagctgtacagcgccctggccaacaagtgctgccacgtgggctgcaccaagagaagcctggccagattctgc

SEQ ID NO: 207 - DNA, 510 bp, Artificial Sequence
  Synthetic Polynucleotide
atgggagttaaagtgctttttgcgcttatttgtattgcggtcgcggaggctgactcatggatggaagaggtcattaagctctgtggaagggaactcgttagagcccaaatagctatttgcgggatgagtacatggtccggtgggggtggttcgggtggaggtgggtcgggaggaggaggctccggtggaggcggcagtgggggcggagggtccggtgggggtgggtctggaggaggtggttcgtttcagtcttcatcttccaaagctcctcctccttcgcttcccagccctagcaggcttccaggtccatcagatactccaatattgccccagggagggggtggatcaggaggaggagggagtggtgggggaggatctggtggaggtggttccggaggaggaggaagcggggggggaggttcaggcggtggtggaagccaactgtatagtgcgttggctaacaaatgttgtcatgtcggatgtactaaaaggagcctcgccaggttttgc

SEQ ID NO: 208 - DNA, 534 bp, Artificial Sequence; identical to SEQ ID NO: 203
  Synthetic Polynucleotide

SEQ ID NO: 209 - DNA, 558 bp, Artificial Sequence
  Synthetic Polynucleotide
atgagcagcagactgctgctgcagctgctgggcttctggctgttcctgagccagccctgcagagccagagtgagcgaggagtggatggaccaggtgatccaggtgtgcggcagaggctacgccagagcctggatcgaggtgtgcggccccagcgtgggcagactggccctgagccaggaggagcccgcccccctggccagacaggccaccgccgaggtggtgcccagcttcatcaacaaggacgccgagcccttcgacatgaccctgaagtgcctgcccaacctgagcgaggagagaaaggccgccctgagcgagggcagagcccccttccccgagctgcagcagcacgcccccgccctgagcgacagcgtggtgagactggagggcttcaagaagaccttccacaaccagctgggcgaggccgaggacggcggcccccccgagctgaagtacctgggcagcgacgcccagagcagaaagaagagacagagcggcgccctgctgagcgagcagtgctgccacatcggctgcaccagaagaagcatcgccaagctgtgc

SEQ ID NO: 210 - DNA, 1236 bp, Artificial Sequence
  Synthetic Polynucleotide
atgggggtgaaggtgctgttcgccctcatctgcatagcggtggccgaggccgactcttggatggaggaggtgatcaagctctgcggcagggagctcgtgcgtgcccagatcgcgatctgcggcatgagcacctggtcagagccaaagagcagcgataagacgcataccagccctcccagccccgcccccgagctgctgggcgggagcagcgtgttcctcttcccacccaagccaaaggacaccctctacatcacccgcgagcccgaggtgacgtgcgttgtggtggacgtgtcccacgaggaccccgaggtcaagttcaactggtacgtggacggcgtggaagtccacaacgccaagaccaagcctcgggaggagcagtacaacagcacctacagggtggtgagcgtcctgacagtcctgcaccaggactggctgaatggcaaggaatacaagtgcaaggtgtcaaacaaggccctgcccgcccccatcgagaaaaccatcagcaaggccaagggccagccacgtgagccccaggtgtacaccctgccccccagcagggacgagctcaccaagaaccaggtgagcctgacctgcctggtgaaaggtttctacccttctgacatcgcggttgagtgggagagcaatggccaacccgagaacaactacaagacaaccccgcccgtgctggactccgatgggagcttcttcctgtatagcaagctgaccgtggacaagagccgctggcagcagggcaacgtgttcagctgctccgtcatgcacgaggccctgcataaccactacacccaaaagagcctgtccctgagccccggcaagcgcaagaagaggtccctgagccaagaagacgccccgcagacgcccaggcccgtggccgagatcgtgcccagcttcatcaacaaggataccgagacaatcaacatgatgtcggaatttgtggctaacctgccccaagagctgaaactgaccctgtcggaaatgcagcccgcgctgccgcagctgcagcagcacgtgccggtgctgaaggatagcagcttgctgttcgaggaattcaagaagctcatccgtaatcgacagagcgaggcggccgattccagccccagcgagctgaagtatctggggctggatacccacagccgcaagaagcggcagctgtactctgctctggccaataagtgttgccacgtcggctgcaccaaacgcagcctggccaggttctgc

SEQ ID NO: 211 - DNA, 1236 bp, Artificial Sequence
  Synthetic Polynucleotide
atgggcgtcaaggtcctcttcgcccttatctgcatcgccgtggccgaggccgacagctggatggaggaggtgatcaagctttgcggccgggagcttgtgcgcgcgcagatcgccatttgcggcatgagcacctggtccgaaccaaagagctccgacaagacccacacctcccctccttcccccgcccccgagctgctgggcggcagcagcgtcttcctgttcccgcccaagcccaaggacaccctgtacatcaccagggagcccgaggtgacatgtgtcgtggtggacgtgtcacacgaggaccccgaggtgaagttcaactggtacgtcgacggcgtggaggtgcacaacgcaaaaaccaagccccgggaggaacagtacaacagcacctaccgggtggtcagcgtgctgaccgtgctccatcaggactggctgaacggcaaggagtacaaatgcaaggtcagcaacaaagccctgcccgccccaatcgaaaagaccatctccaaggccaaggggcagcccagggaaccccaggtgtacaccctgccccccagcagggacgagctcaccaagaaccaggtgagcctgacctgcctggtgaaggggttctaccccagcgacatcgccgtggagtgggaaagcaacggccaacccgaaaacaactacaagaccaccccgccggtgctggactctgacggcagcttcttcctctacagcaagctgaccgttgacaaatccaggtggcaacagggcaacgtcttcagctgcagcgtgatgcatgaagcgctgcacaaccattacacgcagaaaagcctgtccctgagccccggcaagaggaagaaaaggagcctgtcccaggaggacgcccctcagaccccgcgacccgtggccgagatcgtgcctagcttcattaacaaggacaccgagacgatcaacatgatgagcgagttcgtggccaatctgccccaggagctgaagctcaccctcagcgagatgcagcccgccctgccccagctgcagcagcacgtcccggtcctgaaggacagcagcctgctgttcgaggagttcaagaagctgatcaggaacaggcagagcgaggccgccgactcctccccctccgagctgaagtacctcggcctggacacccactccaggaagaagcggcagctgtactcagccctggccaacaagtgctgccacgtgggctgcaccaagcggagcctggcccggttctgc

SEQ ID NO: 212 - DNA, 1236 bp, Artificial Sequence
  Synthetic Polynucleotide
atgggcgtgaaggtgctgttcgccctcatctgcatcgccgtggccgaggccgacagctggatggaggaggtgatcaaactctgcggcagggagctcgtgcgcgcccagatcgccatctgcgggatgtccacctggagcgagcccaagagctccgacaaaacccacaccagcccgcccagcccagcccccgagctgctgggcggcagcagcgtgttcctcttccctcccaagcccaaggacacgctgtacatcacccgggagcccgaggtgacctgcgtggtggtggacgtgagccacgaggaccctgaagtgaagtttaactggtatgttgacggcgtggaggtgcacaacgcaaagaccaagccccgcgaggagcagtacaacagcacctaccgcgtcgtcagcgtgctgacagtcctccaccaggattggctgaacggcaaggagtacaagtgcaaggtgtccaacaaggccctgcccgccccgatcgagaagaccattagcaaggccaagggccagccaagggagccacaagtgtacaccctgccaccttccagggacgagctgaccaagaatcaggtcagcctgacctgcctggttaagggcttctacccaagcgacatcgccgttgagtgggagagcaacggacagcctgagaacaactataagactacccctcccgtgctggattccgacggaagcttcttcctgtacagcaagctgaccgtggacaagagcagatggcagcagggtaacgtgttttcctgctccgtgatgcatgaggccctgcacaaccactacacccagaaaagcctcagcctgagccccggcaaacgcaagaagcggagcctgtcgcaagaggacgccccccagacccccaggcctgtggccgagatcgtccccagcttcatcaacaaggacaccgagactatcaacatgatgagcgaattcgtggccaacctcccccaggaactgaagctgaccctgagcgagatgcagcccgccctgccccagctgcagcagcacgtgcccgtactgaaggacagctccctgctgtttgaagagtttaagaagctgatccggaacaggcagtccgaagccgccgacagctcccccagcgagctgaaatacctggggctggacacccacagccggaaaaagcgccagctctacagcgccctggccaacaagtgctgccacgtgggctgcaccaagcgttccctggcccggttttgc

SEQ ID NO: 213 - DNA, 1236 bp, Artificial Sequence
  Synthetic Polynucleotide
atgggcgtgaaggtcctcttcgccctcatctgcatcgccgtggccgaggccgactcctggatggaggaggtgataaagctctgcggcagggagctcgtgcgcgcccaaatcgccatctgcgggatgagcacctggagcgagcccaagagctccgacaagacacacacctccccgcccagccccgccccagagctgctgggcgggagcagcgtctttctgttcccgcccaagcccaaggacaccctgtacatcacgcgcgagcccgaagtgacctgcgtggtcgtggacgtgagccacgaggaccctgaggtgaagttcaactggtacgtggacggcgtggaggtgcacaacgctaagaccaagccccgggaggagcagtacaactcaacctacagagtggtgagcgtcctcacggtgctgcaccaggattggctgaatggcaaggagtataaatgcaaggtgagcaacaaagcactgcccgcccccatcgagaagacaatctctaaggccaagggccagcccagggagccccaggtgtacaccctgcccccctcaagagacgagctgaccaagaatcaggtgtccctgacctgcctcgtgaagggcttctaccccagcgatatcgctgtggagtgggagtccaacgggcagccggagaacaactacaagaccaccccacccgtgctggacagcgacgggagctttttcctgtacagcaagctgaccgtcgacaagagcagatggcagcagggcaacgtgttcagctgcagcgtcatgcacgaggccctgcacaaccactacacacaaaagagcctgagcctgtcgccaggcaagcgaaagaagagaagcttgagccaggaggacgccccccagaccccccggcccgtggccgagatcgtgcccagcttcatcaacaaggacaccgagactattaacatgatgagcgagttcgtggccaatctgccccaggagctcaaacttaccctgtccgagatgcagcccgccctgccccagctgcagcagcacgtgcccgtgctgaaggacagttccctgctgttcgaggagttcaaaaagctgatccgcaacagacagagcgaggccgccgatagcagcccctccgagctgaagtacctcggcctggacacccacagcaggaagaagaggcagctgtacagcgccctggccaataagtgctgtcacgttggctgcaccaagcgcagcctcgcccggttttgc

SEQ ID NO: 214 - DNA, 1236 bp, Artificial Sequence
  Synthetic Polynucleotide
atgggcgtgaaggtgctgttcgccctcatctgcattgccgtggccgaagccgacagctggatggaagaggtcatcaagctctgcggcagggagctcgtgagggcccagatcgccatctgcggcatgagcacctggagcgagcccaagtccagcgacaagacccacaccagcccgcccagccccgccccggagcttcttgggggcagcagcgtgttcctgttcccacccaagcccaaggacaccctgtacatcacccgggaacccgaggtgacctgcgtggtcgttgacgtcagtcacgaggatcccgaagtcaagtttaactggtatgtggacggcgtggaggtccacaatgccaaaaccaagccacgggaggaacagtataattccacctacagggtggtcagcgtgctcaccgtgctccaccaggactggctcaacggaaaggagtataagtgcaaggtgagcaataaggccctgcctgcccccatcgagaagaccatctccaaggcgaaaggccagccccgggagcctcaggtctacaccctgccccccagccgcgacgagctcaccaagaaccaggtgagcctcacctgcctggtgaagggcttctaccccagcgacatcgccgtggagtgggagtccaacggacagcccgagaacaactacaagaccaccccaccggtcctggacagcgatggctccttcttcctgtacagcaaactgaccgtggacaagagccggtggcagcagggcaacgtgttcagctgcagcgtcatgcacgaggcgctgcacaatcactacacccagaaatccctgagcctgtcccccggcaagaggaagaagaggagcctgagccaggaggacgccccccagacacccaggcccgtggccgagatcgtgccctccttcatcaacaaggataccgaaaccatcaacatgatgagcgagttcgtagccaacctgccgcaggagctcaagctgaccctgagcgagatgcagcccgccctgccccagctgcaacagcacgtgcccgtgctcaaggacagcagcctgctgttcgaggagttcaaaaagctgatccgtaaccgccagagcgaggccgccgattctagcccctccgagctgaagtatctgggactggacacccactcccgcaagaaacggcagctttattccgccctggccaacaagtgctgccacgtgggctgcaccaaaaggtccctggccaggttttgc

SEQ ID NO: 215 - DNA, 1236 bp, Artificial Sequence
  Synthetic Polynucleotide
atgggcgtgaaagtgctctttgccctcatctgcatcgccgtggccgaggccgacagctggatggaggaggtgataaagctctgcgggcgggagctcgtccgggcccagatcgccatctgcggtatgagcacctggagcgagcccaagtccagcgacaagacccacacctcgccccccagcccggcccccgagctgctggggggaagcagcgtgttcctgttcccgcccaagcccaaggacaccctgtacatcacacgagagcccgaagttacctgcgtcgtggtggacgtgagccacgaggaccccgaggtgaagttcaattggtacgtggacggagtggaggtgcacaatgcaaaaaccaagccccgagaggagcagtacaatagcacctacagggtggtgagcgtgctgactgtgctgcaccaggactggctgaacgggaaggagtacaagtgcaaggttagcaacaaggccctccccgccccaatcgagaagaccatctccaaggctaagggccagcccagggagccccaggtctatacactcccgcccagcagagatgagctcaccaagaaccaggtcagcctgacctgtctggtgaaaggcttctaccccagcgacattgccgtggagtgggagtccaacggccagcccgagaacaactacaagaccactccccccgtactggattccgacggcagcttcttcctgtacagcaagctcaccgtggacaaatccaggtggcagcagggcaacgtgttttcctgcagcgtaatgcatgaggccctccacaaccactacacccagaaaagcctgagcctgagccccgggaagaggaagaagaggagcctgtcccaggaggacgccccccagacccccaggcccgtggccgagatcgtccccagcttcatcaataaggacacggagacgatcaacatgatgagcgaattcgtggcaaacctcccccaggagctgaaactgacgctgagcgagatgcagccagccctgcctcagctgcagcaacatgtgcccgtgctgaaggacagctccttgctgttcgaggaattcaagaagctgatccggaacaggcagagcgaggccgccgactccagcccctccgagctgaagtacctgggcctggacacccactcccgaaaaaagcgtcagctgtacagcgccctggcgaacaaatgctgccatgtcggctgtaccaagcggtccctggcccgcttctgc

SEQ ID NO: 216 - DNA, 1236 bp, Artificial Sequence
  Synthetic Polynucleotide
atgggggtgaaggtcctcttcgcgttgatctgcatcgccgtggccgaggcagatagctggatggaggaggttatcaagctctgtggtcgcgagctcgtgcgcgcccaaatcgccatctgcggcatgagcacctggagcgagccgaaaagcagcgacaagacacacacctcccctccgagccccgctcccgagcttctgggtgggtcctcagtgtttctgttcccgcccaagccaaaggacacgctgtacatcaccagagagcccgaagtgacttgcgtggtggtcgacgtgtcccacgaggaccctgaagtcaagttcaactggtacgtggacggcgtggaggtgcacaacgccaagacaaagccccgggaggaacagtacaactccacctaccgggtggtgtccgtgctcaccgtgctccaccaggactggctgaacggcaaggagtacaagtgcaaggtgagcaacaaggctctgcccgcccccatcgagaagacgatctccaaggccaaggggcaacccagggaaccgcaggtctataccctgcccccctctcgggacgagctgacgaagaaccaggttagcctcacctgcctggtgaagggcttctacccctccgacatcgccgtcgagtgggaatccaacgggcagcctgagaacaattacaagaccacccctcccgtcctggactccgacggcagcttctttctctactccaagctcaccgtggacaagtcgaggtggcagcagggaaacgtgttctcctgtagcgtgatgcacgaggccctgcacaaccactacacccagaaaagcctgagcctcagccccgggaagcggaaaaagcgctccctgtcccaggaggacgccccccagacaccccggcccgtggccgagatcgtcccttccttcatcaataaagacaccgagacaatcaacatgatgagcgagttcgtggccaacctgccccaggaactgaagctgaccctctcggagatgcagcccgcgctgccgcagctgcagcagcatgtgcccgtgctgaaagacagcagcctgctgttcgaggagtttaagaagctcatcagaaatagacagagcgaggccgccgatagctccccaagcgagctcaagtacctcgggctggacacgcacagcagaaagaagagacagctgtacagcgccctggccaataagtgctgccacgtcggctgcaccaagcggagcttggcgaggttctgc

SEQ ID NO: 217 - DNA, 1236 bp, Artificial Sequence
  Synthetic Polynucleotide
atgggcgtaaaggtgctctttgccctaatctgcatcgccgtggccgaggccgactcgtggatggaggaggtgatcaagctctgcggccgggagctcgtgcgcgcccagatcgccatctgcgggatgagcacctggagcgagcccaaaagttccgacaagacccacaccagcccgcccagccccgcccccgagctgctgggagggagcagcgtgttcctgttcccacccaagcccaaggacaccctgtacatcacccgcgagcccgaggtgacctgcgtggtggtggacgtgtcccatgaggatccggaggtgaagttcaactggtacgtggacggcgtggaggtgcacaacgccaaaaccaagcccagggaggagcagtacaattccacctacagggtggtgagcgtcctgacggtcctgcaccaagactggctgaatggcaaggagtacaagtgcaaggtgagcaacaaggccctgcccgcgcctatcgagaagacgatcagcaaggccaaaggccaaccgagggagccccaggtgtataccctgccccccagcagggacgagctcaccaagaatcaagtgtcactgacctgcctggtgaagggcttctacccctccgacatcgctgtggagtgggagagcaacggccagcccgaaaataactacaagaccaccccgcccgtgctggacagcgacggcagtttctttctgtacagcaagctgaccgtggacaagtccagatggcagcagggcaacgtgttcagctgtagcgtcatgcacgaggccctgcataatcactacacccagaaaagcctgtccctgagcccagggaagcggaagaagcgatccctcagccaggaggacgccccgcagacccccagacccgttgccgagatcgtgccctcattcatcaacaaggacacagagacaatcaacatgatgtccgaattcgtggccaacctcccccaggagctcaagctgaccctcagcgagatgcagcccgccctgccccagctgcagcagcatgtgcccgtgctgaaggactcgagcctgctgttcgaagagttcaagaagctgatcagaaatcgtcagtccgaggccgccgacagcagccccagcgaactcaagtacctgggcctggacacccacagccgcaagaagaggcagctgtacagcgccctggccaacaagtgctgccacgtgggttgcaccaagcgcagcttggccaggttttgc

SEQ ID NO: 218 - DNA, 1236 bp, Artificial Sequence
  Synthetic Polynucleotide
atgggcgtgaaggtgctgttcgccctcatttgtatcgccgtggccgaagcggacagctggatggaggaggtgatcaaactatgcggcagggagctcgtgagagctcagattgccatctgcggcatgtcgacctggagcgagcccaagagcagcgacaagacccacacctccccgcccagccccgcccccgagctgctggggggcagcagcgtgttcctgtttccccccaagcccaaggacaccctgtacatcacccgagagcccgaggtgacctgtgtggtggtggacgtttcccacgaggaccccgaggtcaagttcaactggtacgtggatggcgtggaggtgcacaatgccaagactaagccccgagaggagcagtacaacagcacctacagggtggtcagcgtgctgaccgtcctgcaccaggactggctgaacgggaaggaatacaagtgcaaggtaagcaacaaggccctgcctgcccccatcgagaagaccatttccaaggccaagggccaaccaagggagccccaggtgtacaccctgccccccagcagagacgaactgaccaagaaccaggtgagcctgacctgcctggtcaaggggttctacccctccgacatcgccgtggagtgggagtccaacggccagcccgagaacaactacaagaccaccccgcccgtcctcgatagcgacgggagcttcttcctgtactcaaagctgacagtggacaagagcaggtggcagcagggcaacgtgttctcctgcagcgtgatgcacgaagccctgcataaccactatacccagaagtccctgagcctgagccccggaaagcgcaaaaagcgcagcctgagccaggaggacgccccacaaacccccaggcccgtggccgagatcgtgcccagcttcatcaacaaggacactgagacgatcaacatgatgtccgagtttgtggccaacctgccccaggagctgaagctgaccctgtctgagatgcagcccgccctgcctcagctccagcagcacgtgcccgtcctcaaggacagcagcctgctgttcgaggagtttaagaagctgatccggaacaggcagtcagaggccgccgacagcagccccagcgagctgaagtacctcggcctggacacacatagccggaagaagaggcagctctacagcgccctcgccaacaaatgctgccacgtgggctgcaccaagaggagcctggccagattctgt

SEQ ID NO: 219 - DNA, 1236 bp, Artificial Sequence
  Synthetic Polynucleotide
atgggcgtgaaggtcctcttcgccctcatctgcatcgccgtggccgaggccgatagctggatggaggaggtcatcaagctctgcgggcgagagctcgtgagagcccagatcgccatctgcggcatgagcacctggagcgagcccaagtcctcggacaagacgcataccagcccgcccagccccgcccccgagctgctggggggcagcagcgtgttcctgttcccacccaagcccaaggacaccctgtatatcacccgggaacctgaggtgacatgcgtggtggtggacgtaagccacgaggacccagaggtgaagtttaactggtacgtggacggggtggaggtgcacaatgccaagaccaagcctagggaggagcaatacaactccacctaccgcgtggtgagcgtgctgacggtcctgcaccaggactggctgaacggcaaagagtacaagtgcaaagtgtccaacaaagccctgcccgcccccatcgagaagaccatctccaaggccaaggggcagcccagagagccccaggtgtacaccctgcccccctctagggacgagctcaccaagaaccaggtgagcctgacctgcctggtgaagggcttctacccgtccgacatcgccgtggagtgggagagcaacggccaacccgagaacaactacaagaccaccccgccggtgctcgactccgacggcagcttcttcctctacagcaagctaaccgtggataagagccgctggcagcagggcaacgtcttcagctgcagcgtcatgcacgaggccctgcacaaccactacacccagaaaagcctgtccctgtcccccggcaagcggaagaagagatcgctgtcccaggaggacgccccccaaacgcccaggcccgtagccgagatcgtgcccagcttcatcaacaaggacaccgagacaattaacatgatgagtgagtttgtggccaatctcccccaggagctgaagctcaccctgagcgagatgcagcccgccctcccccagctgcagcagcacgtgcccgtgctgaaggacagctccctcctgttcgaagagttcaagaagctgatcaggaaccggcagagcgaggccgccgactccagccccagcgagctgaagtacctgggtctggatacccactccaggaagaagcggcagctgtacagcgccctggccaacaagtgttgtcacgtcggttgcacgaaacggtcgctcgcccggttttgt

SEQ ID NO: 220 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacaccagccccccaagccccgctcccgagctgctgggcggcagcagcgtgttcctgttccctcctaaacctaaggacaccctgtacatcacccgggagcccgaggtgacctgcgtggtggtggacgtgagccacgaggaccctgaggtgaagttcaactggtacgtggacggcgtggaggtgcacaacgccaagaccaagccacgggaggagcagtacaacagcacctaccgggtggtgagcgtgctgaccgtgctgcaccaggactggctgaacggcaaggagtacaagtgcaaggtgagcaacaaggccctgcctgcgcccatcgagaagaccatcagcaaggccaaggggcagcctagagaaccccaggtgtacaccctgcctcccagccgggacgagctgaccaagaaccaggtgagcctgacctgcctggtgaagggcttctaccccagcgatattgctgtggagtgggagagcaacggccagcctgagaacaactacaagaccacccctcccgtgctggacagcgacggcagcttcttcctgtacagcaaactgacagtggacaagagccggtggcagcagggcaacgtgttcagctgcagcgtgatgcacgaagccctgcacaaccactacacccagaaaagcctaagcctgtcacccggcaagcggaagaagcggtccttgagccaggaggacgcgcctcagaccccccggcctgtggctgaaatcgtgcccagcttcatcaacaaagacaccgagacgataaacatgatgagcgagttcgtggccaacctgccccaggagctgaagctcaccttgagcgagatgcagcccgctctgccacaactccagcagcacgtgcccgtccttaaggacagcagcctgcttttcgaggagttcaagaagctgatccggaaccggcagagcgaggccgccgatagctcccctagcgagctcaagtacctgggcctggacacccacagcagaaagaagcgccagctgtatagcgccctggccaacaagtgctgccacgtgggatgcacaaaaagaagcttggcccggttctgc

SEQ ID NO: 221 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacacctctcctccgtcccccgctcccgagctgctgggcggcagcagcgtgttcctgttccctcccaagcccaaggacaccctgtacatcacccgggagcccgaggtgacctgcgtggtggtggacgtgagccacgaggaccctgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgccagcccctatcgagaagaccatcagcaaggccaaggggcagcccagggagccacaggtgtacaccctgccgcccagccgggacgagctgaccaagaaccaggtgagcctgacctgcctggtgaagggcttctaccccagcgacatcgctgtggagtgggagagcaacggccagccggagaacaactacaagaccaccccacccgtgctggacagcgacggcagcttcttcctgtacagcaagctcaccgtagacaagagccggtggcagcagggcaacgtgttcagctgcagcgtgatgcacgaggccctacacaaccactacacccagaaaagcctgagcctatcccccggcaagcggaagaagagatcgctgagccaggaggacgccccccagaccccccggcccgtagccgagatcgtgcccagcttcatcaacaaagacactgaaacgatcaacatgatgagcgagttcgtggccaacctgccccaggagctgaagctcacactgagcgagatgcagcccgctctgccacagctccagcagcacgtgcccgtcctgaaggacagcagcctgcttttcgaggagttcaagaagctgatccggaaccggcagagcgaggccgctgacagctcacccagtgaacttaagtacctgggcctggacacccacagccgcaagaagcggcagctgtactccgccctggccaacaagtgctgccacgtggggtgcaccaaacgcagcctggcccggttctgc

SEQ ID NO: 222 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacacctccccacctagcccagcccccgagctgctgggcggcagcagcgtgttcctgttcccacccaagcccaaggacaccctgtacatcacccgggagcccgaggtgacctgcgtggtggtggacgtgagccacgaggaccccgaggtcaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcccgctcccatcgagaagaccatcagcaaggccaagggccagcccagggagccccaggtgtacaccctgcctcccagccgggacgagctgaccaagaaccaggtgagcctgacctgcctggtgaagggcttctaccccagcgacatcgctgtcgagtgggagagcaacggacagcccgagaacaactacaagaccacccctcccgtgctggacagcgacggcagcttcttcctgtacagcaaactgactgtggacaagagccggtggcagcagggcaacgtgttcagctgcagcgtgatgcacgaggccttgcacaaccactacacccagaaaagcctgtccctgtcccccggcaagcggaagaagcggtcactgtcccaggaggacgctccgcagaccccccggccagtggcggagatcgtgcccagcttcatcaataaggataccgagacaattaacatgatgagcgagttcgtggccaacctgccccaggagctgaagctgaccctgagcgagatgcagcccgctctgccgcagttacagcagcacgtgcccgtcctgaaggacagcagcctgctgtttgaggagttcaagaagctgatccggaaccggcagagcgaggccgccgatagctccccatctgagctcaagtacctgggcctggacacccacagcagaaagaaaaggcagctgtactccgccctggccaacaagtgctgccacgtgggatgcaccaagagatctctggcccggttctgc

SEQ ID NO: 223 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacacctcacctccatccccggcacccgagctgctgggcggcagcagcgtgttcctgttccctcccaagcccaaggacaccctgtacatcacccgggagcccgaggtgacctgcgtggtggtggacgtgagccacgaggaccccgaagtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgcgcctatcgagaagaccatcagcaaggccaagggccagccacgggaaccccaggtgtacaccctgcctcccagccgggacgagctgaccaagaaccaggtgagcctgacctgcctggtgaagggcttctaccccagcgatatcgctgtggagtgggagagcaacggccaacccgagaacaactacaagaccaccccacccgtgctggacagcgacggcagcttcttcctgtacagcaaactaaccgtggacaagagccggtggcagcagggcaacgtgttcagctgcagcgtgatgcacgaagccctgcacaaccactacacccagaaaagcctctccctgagccccggcaagcggaagaagcggtccttgtcacaggaggacgccccccagaccccccggcccgtcgctgagatcgtgcccagcttcatcaacaaagacaccgaaacaattaacatgatgagcgagttcgtggccaacctgccccaggagctgaagctgacactgagcgagatgcagcccgctctgccacaactgcagcagcacgtgccagtgctcaaggacagcagcctcctgttcgaggagttcaagaagctgatccggaaccggcagagcgaggccgcggacagctcaccaagcgagctgaaatacctgggcctggacacccacagccgcaaaaagagacagctgtactccgccctggccaacaagtgctgccacgtgggatgcaccaaaagaagcctggcccggttctgc

SEQ ID NO: 224 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacaccagccccccttcccccgcccccgagctgctgggcggcagcagcgtgttcctgttcccgcccaagcccaaggacaccctgtacatcacccgggagcccgaggtgacctgcgtggtggtggacgtgagccacgaggaccccgaagtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcccgctcccatcgagaagaccatcagcaaggccaagggccagccaagagaaccccaggtgtacaccctgcccccctcccgggacgagctgaccaagaaccaggtgagcctgacctgcctggtgaagggcttctaccccagcgacattgccgtggagtgggagagcaacggccagcccgagaacaactacaagaccaccccacccgtgctggacagcgacggcagcttcttcctgtacagcaagctgactgtggacaagagccggtggcagcagggcaacgtgttcagctgcagcgtgatgcacgaggccttgcacaaccactacacccagaaaagcctgtcccttagccccggcaagcggaagaagaggagccttagccaggaggacgccccacagaccccccggcccgtggctgaaatcgtgcccagcttcatcaacaaagacacagaaaccatcaacatgatgagcgagttcgtggccaacctgccccaggagctgaagctcaccctgagcgagatgcagcccgcattgccacagctccagcagcacgtgcctgtgctgaaggacagcagcttgctctttgaggagttcaagaagctgatccggaaccggcagagcgaggccgccgactccagcccctctgagttaaagtacctgggcctggacacccacagcagaaagaagcggcagctgtactcagccctggccaacaagtgctgccacgtgggctgcacaaagcggagcctggcccggttctgc

SEQ ID NO: 225 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacaccagccccccaagccccgcccccgagctgctgggcggcagcagcgtgttcctgttcccgcccaagccaaaggacaccctgtacatcacccgggagcccgaggtgacctgcgtggtggtggacgtgagccacgaggacccagaagtcaagttcaactggtacgtggacggcgtggaggtgcacaacgccaagaccaagccacgggaggagcagtacaacagcacctaccgggtggtgagcgtgctgaccgtgctgcaccaggactggctgaacggcaaggagtacaagtgcaaggtgagcaacaaggccctgcctgcacccatcgagaagaccatcagcaaggccaaggggcagcctagagagccccaggtgtacaccctgccacctagccgggacgagctgaccaagaaccaggtgagcctgacctgcctggtgaagggcttctaccccagcgacatcgctgtggagtgggagagcaacggccagcctgagaacaactacaagaccaccccgcccgtgctggacagcgacggcagcttcttcctgtacagcaagctcacggtagacaagagccggtggcagcagggcaacgtgttcagctgcagcgtgatgcacgaagctctgcacaaccactacacgcagaaaagcttgagcctgtcacccggcaagcggaagaagcggtccctgtcccaggaggacgcccctcagaccccccggccagtagcggagatcgtgcccagcttcatcaacaaggatacagagactatcaacatgatgagcgagttcgtggccaacctgccccaggagctgaagctgactctgagcgagatgcagcccgcgctgcctcaactgcagcagcacgtgcccgtactgaaggacagcagcttgctctttgaggagttcaagaagctgatccggaaccggcagagcgaggccgcagacagctcacccagcgaattgaagtacctgggcctggacacccacagcagaaagaagcgacagttgtactccgccctggccaacaagtgctgccacgtgggttgcaccaagaggtcgctggcccggttctgc

SEQ ID NO: 226 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacacctcaccaccaagccctgcacccgagctgctgggcggcagcagcgtgttcctgttccctcccaagcccaaggacaccctgtacatcacccgggagcccgaggtgacctgcgtggtggtggacgtgagccacgaggacccagaggtcaagttcaactggtacgtggacggcgtggaggtgcacaacgccaagaccaaaccccgggaggagcagtacaacagcacctaccgggtggtgagcgtgctgaccgtgctgcaccaggactggctgaacggcaaggagtacaagtgcaaggtgagcaacaaggccctgccggcccctatcgagaagaccatcagcaaggccaagggccagccaagggaaccccaggtgtacaccctgccacccagccgggacgagctgaccaagaaccaggtgagcctgacctgcctggtgaagggcttctaccccagcgacatcgcagtggagtgggagagcaacggccagcccgagaacaactacaagaccaccccacccgtgctggacagcgacggcagcttcttcctgtacagcaagctgactgtcgacaagagccggtggcagcagggcaacgtgttcagctgcagcgtgatgcacgaggccttgcacaaccactacacccagaaaagcctctctctttctcccggcaagcggaagaagaggagcctgtcccaggaggacgccccccaaactccccggcccgtcgctgagatcgtgcccagcttcatcaataaagacacggagacaatcaacatgatgagcgagttcgtggccaacctgccccaggagctgaagctgacactgagcgagatgcagcccgcacttccccagctccagcagcacgtgcccgtcctgaaggacagcagcttactcttcgaggagttcaagaagctgatccggaaccggcagagcgaggccgcagattctagcccctccgaactcaaatacctgggcctggacacccacagcagaaagaaaagacagctgtattcagccctggccaacaagtgctgccacgtgggctgcacaaagcggagcctcgcccggttctgc

SEQ ID NO: 227 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacacctcccctcccagtcctgcccccgagctgctgggcggcagcagcgtgttcctgttcccgcccaagcccaaggacaccctgtacatcacccgggagcccgaggtgacctgcgtggtggtggacgtgagccacgaggaccctgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcccgccccaatcgagaagaccatcagcaaggccaagggccagcctagggagccgcaggtgtacaccctgccaccctctcgggacgagctgaccaagaaccaggtgagcctgacctgcctggtgaagggcttctaccccagcgatatcgccgtcgagtgggagagcaacggccaacctgagaacaactacaagaccacccctcccgtgctggacagcgacggcagcttcttcctgtacagcaagctcaccgtggacaagagccggtggcagcagggcaacgtgttcagctgcagcgtgatgcacgaagccctgcacaaccactacacccagaaaagcttgagcctcagtcccggcaagcggaagaagcgatccttgagccaggaggacgctcctcagaccccccggcctgtggcggagatcgtgcccagcttcatcaacaaagacactgaaaccattaacatgatgagcgagttcgtggctaacttgccccaggagctgaagctgactctgagcgagatgcagcccgctctcccgcagcttcagcagcacgtgcccgtgttgaaggacagcagcctcctcttcgaggagttcaagaagctgatccggaaccggcagagcgaggccgctgattcttcccctagcgaactgaaatacctgggcctggacacccacagcagaaagaagaggcagctgtactctgccctggccaacaagtgctgccacgtgggctgcacaaagaggagcctggcccggttctgc

SEQ ID NO: 228 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacacctcccctccgtcccccgctcccgagctgctgggcggcagcagcgtgttcctgttccctcccaagcccaaggacaccctgtacatcacccgggagcccgaggtgacctgcgtggtggtggacgtgagccacgaggacccagaagtcaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgctcctatcgagaagaccatcagcaaggccaagggccagcctcgggaaccccaggtgtacaccctgccccctagccgggacgagctgaccaagaaccaggtgagcctgacctgcctggtgaagggcttctaccccagcgatattgccgtggagtgggagagcaacgggcagcccgagaacaactacaagaccaccccgcccgtgctggacagcgacggcagcttcttcctgtacagcaagcttaccgtcgacaagagccggtggcagcagggcaacgtgttcagctgcagcgtgatgcacgaagccctgcacaaccactacacccagaaaagcctctccctgtctcccggcaagcggaagaagcgcagtctctctcaggaggacgctcctcagaccccccggcccgtcgccgaaatcgtgcccagcttcatcaacaaagacactgaaaccataaacatgatgagcgagttcgtggccaacctgccccaggagctgaagttgactctgagcgagatgcagcccgccctgccacagctccagcagcacgtgcccgtcctgaaggacagcagcctgttgttcgaggagttcaagaagctgatccggaaccggcagagcgaggccgccgattccagcccctctgagctcaagtacctgggcctggacacccacagccggaagaaaaggcagttatacagcgccctggccaacaagtgctgccacgtgggatgtaccaagaggagtctggcccggttctgc

SEQ ID NO: 229 - DNA, 1236 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgagcccaagagcagcgacaagacccacaccagtcccccctctcccgcacccgagctgctgggcggcagcagcgtgttcctgttccctcccaagcccaaggacaccctgtacatcacccgggagcccgaggtgacctgcgtggtggtggacgtgagccacgaggaccccgaggtcaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgccggcgccaatcgagaagaccatcagcaaggccaagggtcagcccagggagccccaggtgtacaccctgcctccctctcgggacgagctgaccaagaaccaggtgagcctgacctgcctggtgaagggcttctaccccagcgacatcgctgtggagtgggagagcaacggccagcccgagaacaactacaagaccacccctcccgtgctggacagcgacggcagcttcttcctgtacagcaagctgacagtggacaagagccggtggcagcagggcaacgtgttcagctgcagcgtgatgcacgaggccttgcacaaccactacacccagaaaagcctgagcctctcccccggcaagcggaagaagaggagcctcagccaggaggacgctccccagaccccccggccagtggccgaaatcgtgcccagcttcatcaacaaggatacagagacaattaacatgatgagcgagttcgtggccaacctgccccaggagctgaagctcacactgagcgagatgcagcccgccctgccacagttgcagcagcacgtgcccgtactcaaggacagcagcctccttttcgaggagttcaagaagctgatccggaaccggcagagcgaggccgccgacagtagcccaagcgaactcaagtacctgggcctggacacccacagcaggaaaaagagacagctgtatagcgccctggccaacaagtgctgccacgtgggctgtaccaagcggagcttggcccggttctgc

SEQ ID NO: 230 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggaggtggtggctcaggcggcgggggatccggcggtggtggtagcggcggaggcgggtctggtggcggcggttcagggggagggggcagtgggggaggaggctctttccagagctcctcctccaaggccccaccccctagcctgcccagccccagccggctgcccggccccagcgacacccccatcctgccccaaggagggggtggctccgggggcggtggatcgggtggaggcggctcaggtggcgggggttctggggggggcggatctggcggaggagggtcggggggtgggggatcacagctgtacagcgccctggccaacaagtgctgccacgtgggctgcaccaagcggagcctggcccggttctgc

SEQ ID NO: 231 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggcggcggggggtcagggggaggagggtccgggggaggcgggagcggtggaggcggctccggtggtgggggttctggcggcggtggcagtgggggagggggatccttccagagctcatcctccaaggctcctcccccgagcctgcccagccccagccggctgcccggccccagcgacacccccatcctgccccaggggggcggcggctcaggcgggggtggtagtggcggaggaggatctggagggggcgggtcaggagggggtggaagcggggggggtggctctggtggcgggggctctcagctgtacagcgccctggccaacaagtgctgccacgtgggctgcaccaagcggagcctggcccggttctgc

SEQ ID NO: 232 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggagggggtggatctggggggggcggcagcggtgggggcgggtccggcggaggtggaagtggcggggggggttcaggagggggaggctctggaggcggaggaagtttccagagctcctcctcaaaggcgcctcccccaagcctgcccagccccagccggctgcccggccccagcgacacccccatcctgccccaaggtggcggtggtagcgggggtggtgggtcaggcggcggcggatcgggtggcggagggtctggtggaggtgggagcggcgggggcggtagcggcggtggcggctcccagctgtacagcgccctggccaacaagtgctgccacgtgggctgcaccaagcggagcctggcccggttctgc

SEQ ID NO: 233 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggtggcggcggatctggcggtggggggtcgggtgggggaggttccgggggaggcggttcagggggcgggggctcaggcggtggtggaagtgggggcggcggcagtttccagagctccagctccaaggccccgcctcccagcctgcccagccccagccggctgcccggccccagcgacacccccatcctgccccagggagggggagggtcaggaggcggagggtccgggggtggaggatcgggaggtggcggtagcggcggggggggcagcggaggcgggggatctggtggtgggggttctcagctgtacagcgccctggccaacaagtgctgccacgtgggctgcaccaagcggagcctggcccggttctgc

SEQ ID NO: 234 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggcggcggtggcagtgggggcggagggtctggtggtgggggctctggcgggggaggaagtggagggggcggctctggaggtggaggctcaggtgggggtgggagcttccagagctctagcagcaaggcgccacccccaagcctgcccagccccagccggctgcccggccccagcgacacccccatcctgccccagggcggcggaggttctgggggagggggttccggcggggggggcagcggaggggggggtagcgggggtggcgggagcggaggagggggatccggtggcggaggatcccagctgtacagcgccctggccaacaagtgctgccacgtgggctgcaccaagcggagcctggcccggttctgc

SEQ ID NO: 235 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggtggaggggggtcagggggagggggctccggcgggggaggctcgggaggaggcggttcaggtgggggcggctctggtggaggcggatccggtggcggggggagcttccagagcagctcgtccaaggcccctcccccaagcctgcccagccccagccggctgcccggccccagcgacacccccatcctgccccagggtgggggaggaagcggaggtggtggctccgggggcggtggcagtggcggagggggttctggggggggcgggtcgggtggaggtggaagcgggggtggtggatcccagctgtacagcgccctggccaacaagtgctgccacgtgggctgcaccaagcggagcctggcccggttctgc

SEQ ID NO: 236 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgggggtggtggatcaggtggaggcggcagtggcgggggcggttctgggggaggagggtcgggaggggggggatctggtggtggcggaagtggcggcggtggatccttccagagcagtagctctaaggccccaccgcccagcctgcccagccccagccggctgcccggccccagcgacacccccatcctgccccagggtgggggtggctccggcggcggaggctctgggggcggcgggagcggagggggcgggtcaggcggggggggctcagggggaggtgggtccggtggaggtggaagtcagctgtacagcgccctggccaacaagtgctgccacgtgggctgcaccaagcggagcctggcccggttctgc

SEQ ID NO: 237 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggcggaggtggatcaggcggcggtgggtccgggggtggcgggtcagggggcggagggtccggcggcgggggaagcggtggcggtggctccggaggaggaggctctttccagagctcctcatctaaggccccgccgcccagcctgcccagccccagccggctgcccggccccagcgacacccccatcctgccccagggcggtggaggcagtggtgggggagggagtggaggcggggggagtgggggcgggggttcgggtggtggaggtagcgggggcggcggatctggtggcggaggaagccagctgtacagcgccctggccaacaagtgctgccacgtgggctgcaccaagcggagcctggcccggttctgc

SEQ ID NO: 238 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcgggggaggtgggtcaggtggcgggggatccggcggagggggttcaggaggcggcgggagcggaggtggtggttcgggtggaggggggagcggtggcggaggaagcttccagagctcctcctctaaggccccgccccctagcctgcccagccccagccggctgcccggccccagcgacacccccatcctgccccaggggggcggtggaagcggcgggggcggatctgggggtgggggctctggtgggggagggagtggggggggaggctcagggggtggtggctctgggggcggcggctcacagctgtacagcgccctggccaacaagtgctgccacgtgggctgcaccaagcggagcctggcccggttctgc

SEQ ID NO: 239 - DNA, 510 bp, Artificial Sequence
  Synthetic Polynucleotide
atgggcgtgaaggtgctgttcgccctgatctgcatcgccgtggccgaggccgacagctggatggaggaggtgatcaagctgtgcggccgggagctggtgcgggcccagatcgccatctgcggcatgagcacctggagcggcggaggcggaagcggcggggggggcagtggtggaggtggttctggtggcgggggatctggaggcggcgggtcaggcggtgggggcagcggaggagggggctctttccagagctcctcatctaaggctcctcccccaagcctgcccagccccagccggctgcccggccccagcgacacccccatcctgccccagggagggggagggagtgggggcggcggctctgggggtggaggctcagggggcggaggaagcggagggggtggtagcgggggcgggggtagtggggggggtggctcccagctgtacagcgccctggccaacaagtgctgccacgtgggctgcaccaagcggagcctggcccggttctgc

SEQ ID NO: 240 - DNA, 1236 bp, Artificial Sequence; identical to SEQ ID NO: 204
  Synthetic Polynucleotide

SEQ ID NO: 241 - DNA, 1257 bp, Artificial Sequence
  Synthetic Polynucleotide
atgcccagactgttcttcttccacctgctgggcgtgtgcctgttacttaaccagttcagcagagccgtggccgacagctggatggaggaggtgatcaagctgtgcggcagagagctggtgagagcccagatcgccatctgcggcatgtctacctggagcgagcccaagagcagcgacaagacccacaccagcccccccagccccgcccccgagctgctgggcggcagcagcgtgttcctgttcccccccaagcccaaggacaccctgtacatcaccagagagcccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacgggaaggagtacaagtgcaaggtgagcaacaaggccctgcccgcccccatcgagaagaccatcagcaaggccaagggccagcccagagagccccaggtgtacaccctgccccccagccgagacgaactgaccaagaatcaggtgagcctgacctgcctggtgaagggcttctaccccagcgacatcgccgtggagtgggaaagcaacggccagcccgagaacaactacaagaccaccccccccgtgctggacagcgacggcagcttcttcctgtatagcaagctgaccgtggacaagtcaagatggcagcagggcaacgtgttcagctgcagcgtgatgcacgaggccctgcacaaccactacacccagaagagcctgagcctgagccccggcaagagaaagaagagaagcctgagccaggaggacgccccccagacacctagacccgtggccgagatcgtgcccagctttatcaacaaggacaccgagaccatcaacatgatgtccgagttcgtggccaacctgccccaggagctgaagctgaccctgagcgagatgcagcccgccctgccccagctgcagcagcacgtgccagtgctgaaggacagcagcctgctgttcgaggagttcaagaagctgatcagaaacagacagagcgaggccgccgacagcagccccagcgagctgaagtacctgggcctggacacccacagcagaaagaagagacaactgtacagcgccctggccaataagtgctgccacgtgggctgcaccaagagaagcctggccagattctgc

SEQ ID NO: 242 - DNA, 531 bp, Artificial Sequence
  Synthetic Polynucleotide
atgcctaggttgtttttctttcacttactaggagtatgtttactcctgaatcaattttctagggctgtcgcagatagttggatggaggaggtaatcaaattatgtggaagagagttagttcgtgctcaaatagctatttgtggtatgtcaacttggagcggagggggcggctcgggcggagggggaagcggagggggtggctcaggagggggcggttctggtggcggcggatcaggtggtggaggatcaggaggcgggggcagctttcagtcgtcgtcatccaaagcgcctccaccctcactgccctccccctccagattacctgggccctccgatacccccattttgccacaagggggtggaggatccggggggggaggcagtggtggtggtggtagcggtggtgggggctccggtggaggcggaagtggtgggggaggatccggggggggcggatcgcagctctattccgctcttgccaataaatgttgccacgtcggttgtacaaaacggtccctggccagattctgc

SEQ ID NO: 243 - DNA, 1257 bp, Artificial Sequence; identical to SEQ ID NO: 241
  Synthetic Polynucleotide

SEQ ID NO: 244 - DNA, 1236 bp, Artificial Sequence; identical to SEQ ID NO: 206
  Synthetic Polynucleotide

SEQ ID NO: 245 - DNA, 1257 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaagaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 246 - DNA, 1257 bp, Artificial Sequence; identical to SEQ ID NO: 245
  Synthetic Polynucleotide

SEQ ID NO: 247 - DNA, 918 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcgaggtgcagctgctggagagcggcggcggcctggtgcagcccggcggcagcctgaggctgagctgcgtggccagcggcttcaccttcaacagcagcgccatgagctgggtgaggcaggcccccggcaagggcctggagtgggtgagcgccatcagcggcagcggcgacaggacctactacgccgacagcgtgaagggcaggttcaccatcagcagggacaacagcaagaacaccctgtacctgcagatgaacagcctgagggccgaggacaccgccgtgtactactgcaccaccgacccccccaggtaccactacaacggcctggccgtgaggggccagggcaccaccgtgaccgtgagcagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 248 - DNA, 918 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcgaggtgcagctgctggagagcggcggcggcctggtgcagcccggcggcagcctgaggctgagctgcgccgccagcggcttcaccttcagcagctacgccatgagctgggtgaggcaggcccccggcaagggcctggagtgggtgagcgccatcagcggcagcggcggcagcacctactacgccgacagcgtgaagggcaggttcaccatcagcagggacaacagcaagaacaccctgtacctgcagatgaacagcctgagggccgaggacaccgccgtgtactactgcaccaaggacccccccaggtaccactacaccggcctggccgtgaggggccagggcaccaccgtgaccgtgagcagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 249 - DNA, 531 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggtccgggtcgaccgatagcggttccgacacttcctccggaaactccggggacggcaacagcggcttccagtcgagctcctcaaaggccccacctccctcactgccctccccttctcggctccctggaccgtccgatactccgatcctgccgcaattccagtccagcagctccaaggcccctccaccgtcactgccatccccgtcgaggttgccgggaccctcagacacgcccatcctgcctcagggcagcaccgactcgggatccgatacctcgtccgggaactccggcgacgggaactcgggacaactctacagtgcattggctaataaatgttgccatgttggttgtaccaaaagatctcttgctagattttgc

SEQ ID NO: 250 - DNA, 441 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggtccggaggaggagggtccttccagtcaagcagctccaaggcccctccaccaagcctccctagcccgtccaggcttccgggaccgtcggatactcccatcctgccccagttccagtcctcgtcgtccaaggctccccctccatccctgccctcaccctcacggctgccaggaccgtccgacacccctatcctgccgcaaggcggtggagggtcacaactctacagtgcattggctaataaatgttgccatgttggttgtaccaaaagatctcttgctagattttgc

SEQ ID NO: 251 - DNA, 1257 bp, Artificial Sequence
  Synthetic Polynucleotide
atgccgagactgttcttcttccacctcctcggcgtgtgcctcctcctcaaccagttctctcgagccgtggcggatagctggatggaggaggtgatcaagctctgtggccgtgagctcgtccgggcccagatcgccatctgcggcatgtccacctggtccgagcccaagtcctccgacaagacccacacctcgccccccagccctgcccccgagctcctgggcggcagctccgtcttcctgttcccgcccaagccgaaggataccctgtacatcaccagggagcccgaggtgacctgtgtcgtggtggacgtgagccacgaggaccccgaggtgaagtttaattggtacgtcgacggcgtggaggtgcacaacgccaagaccaagcccagggaggagcagtacaactccacctaccgggtggtgagcgtgctgacagtcctgcatcaggactggctgaacggcaaggaatacaagtgcaaggtgagcaacaaggccctgcccgcccccatcgagaagaccatcagcaaggccaagggccaaccccgggaaccccaggtctacaccctgcctcccagcagggatgagctgaccaagaaccaggttagcctgacctgcctggtcaagggcttctacccctccgacattgccgtggagtgggagagcaacggtcagcccgagaacaactacaagaccacccctcccgtgctcgacagcgacggttccttcttcctgtacagcaagctgacggtggacaagagccgctggcagcagggcaacgtgttcagctgctccgtgatgcacgaagccctgcacaaccactacacccagaagtccctgagcctgtcacccggcaagaggaagaagcggagcctgtcccaggaggatgccccccagacccctagacctgtggccgaaattgtgccctcctttatcaacaaggacaccgaaaccatcaatatgatgtccgagttcgtggccaacctgccccaggagctgaaactcaccctgagcgagatgcagcccgccctgccccagctgcaacagcacgtgcccgtgctgaaggactcatctctgctgttcgaggaattcaagaagctgatcaggaacaggcagagcgaggccgccgacagcagtcccagcgagctgaaatacctgggcctggacacccactcccgcaagaagcggcagctgtacagcgccctggccaacaagtgctgccacgtaggctgcaccaaacgcagcctggcacggttctgc

SEQ ID NO: 252 - DNA, 1257 bp, Artificial Sequence
  Synthetic Polynucleotide
atgccccgtctcttcttcttccacctcctcggagtgtgcctcctcctcaaccagttcagcagggccgtggccgactcctggatggaggaagtgatcaagctctgcggcagggagctcgtgagggcccaaatcgccatctgcggcatgagcacctggtccgagcccaagagctccgacaagactcacaccagccccccgagccccgcccccgagctgctgggcgggagcagcgtgtttctgttccctcccaagcccaaggacaccctgtacatcacccgcgagccggaagtgacctgcgtggtggtggacgtctcccacgaggaccccgaggtgaaattcaactggtacgtggacggcgtggaagtgcacaatgcgaagaccaagcccagggaggagcagtacaacagcacctacagggtagtcagcgtgctgaccgtgctgcatcaggactggctgaatggcaaggagtacaagtgcaaagtgtccaataaggctctgcccgcccccatcgagaagaccatcagcaaagccaagggacagcccagagagccccaggtgtacaccctgcccccgagcagggacgagctgaccaagaaccaggtcagcctgacctgcctggtgaaggggttttaccccagcgacatcgccgtggagtgggagagcaacggccagcccgagaacaactacaagacgacacccccggtgctggacagcgacgggtctttcttcctgtacagcaagctgaccgtggataaatccagatggcagcagggcaacgtcttcagctgctccgtgatgcatgaggccctgcacaaccactacacgcagaagtcactgtccctgagccccggcaagaggaagaagcggagcctgagccaggaggacgccccccagaccccccggcccgtggcggagatcgtgcctagcttcatcaacaaggacaccgagactatcaacatgatgagcgagttcgtggccaacctgccccaggagctgaagctcaccctgtccgaaatgcagccggccctcccgcagctgcagcagcacgtacccgtgctgaaagattccagtctgctgtttgaggagttcaagaagctgatcaggaatcggcagtccgaggccgccgacagcagcccgtccgagttgaagtacctcggcctggatacccattcgcggaagaagaggcaactgtactccgccctggccaacaagtgctgtcacgtggggtgcacaaagagaagcctggcccgtttctgc

SEQ ID NO: 253 - DNA, 1257 bp, Artificial Sequence
  Synthetic Polynucleotide
atgcccaggctgttcttcttccacctcctcggcgtgtgtctcctcctcaaccaatttagccgtgccgtggcggacagctggatggaggaggtgatcaagctctgtggtagagagctcgtccgtgcccagattgccatctgtggcatgtccacctggagcgagcccaagtccagcgacaagacccacaccagcccgcccagccctgcccccgagctgctgggcggcagcagcgtgttcctgttcccgcccaagcccaaggacacactgtacataacccgggagcccgaggtgacctgtgtggtggtcgacgtcagccacgaggaccccgaggtcaaattcaactggtacgtggacggcgtggaggtgcacaacgccaagactaaaccccgggaggaacaatacaactccacctacagggtggtatccgtgctgaccgtcctgcaccaggattggctcaacggcaaagagtataagtgcaaagtgtccaacaaggccctgcccgcccccatcgagaagacgatcagcaaggccaagggccagccccgggagccccaggtctacacgctgccccccagcagagacgagcttaccaagaaccaggtttccctgacctgcctggtgaagggcttctacccgagcgacattgccgtggagtgggagagcaacggccagcccgagaataactacaagaccacgccccccgtgctcgactccgacggcagcttctttctctactccaagctgaccgttgacaagagccgctggcagcagggaaacgtgttcagctgcagcgtcatgcacgaggccctgcacaaccactacacgcagaagtccctgagcctgtcccccggcaaacgtaagaagaggagcctgagccaggaggacgccccccagacccccaggccagtggccgagatcgtcccctccttcataaacaaggacaccgaaaccatcaacatgatgagcgagttcgtggccaacctgccccaggagctgaagctgaccctcagcgagatgcagcccgccctcccccaactccagcagcacgtgcccgtgctcaaggacagcagcctgctgtttgaggagttcaagaaactgatccgcaacagacagagcgaggccgccgacagcagccccagcgagctcaagtacctgggtctggacacccatagcaggaagaagaggcagctgtacagtgccctggcgaacaagtgctgccacgtgggctgcaccaagaggagccttgccaggttctgc

SEQ ID NO: 254 - DNA, 1257 bp, Artificial Sequence
  Synthetic Polynucleotide
atgccgagacttttcttcttccacttgctcggcgtgtgcctcctccttaaccaatttagcagagccgtggcagactcctggatggaggaggtgatcaagctctgcggcagggagctcgtgagggcgcagatcgccatttgcggtatgtccacatggagcgagcccaagagctcagataagacccacaccagccctcccagccccgcccccgagctgctgggcggcagcagcgtgttcctcttcccgcccaaacccaaggacaccctgtacatcaccagggagcccgaggtgacctgcgtggtcgtcgacgtatcccacgaggaccccgaggtgaagttcaactggtacgtggacggggtggaggtgcataacgccaagaccaagccccgggaggagcagtacaacagcacctaccgggtggtgtccgtgctgacagtcctgcaccaggactggctgaacggcaaggagtacaagtgcaaggtcagcaacaaagccctgcccgcccccatcgagaagaccatctcaaaggccaaggggcagccccgcgagccacaggtgtatacgctgccgcccagcagagacgagctgaccaagaaccaggtgagcctgacctgcctggtcaagggcttctatcccagcgacatcgccgttgagtgggagagcaacggccagcccgagaacaactataagaccactccacccgtcctggacagcgatgggagcttcttcctgtactccaagctgaccgtggacaagagccgctggcagcagggcaatgtgttcagctgctccgtgatgcacgaggccctgcataaccattacacccagaagtcgctgagcctgagccctggcaagaggaagaaacgcagcctgagccaggaggatgccccgcagacccctcggccggtggccgagatcgtgccttccttcatcaacaaggacaccgagacaatcaacatgatgtccgagttcgtagccaatctgccccaggagctgaagctgaccctctccgagatgcagcccgccctgccccagctgcagcaacacgtcccggtgctcaaggacagcagcctgctgttcgaggagtttaagaagctgatccgcaacaggcagtccgaggccgccgatagcagccccagcgagctgaagtacctgggcctcgacacacatagcaggaagaagcggcagctctactccgccctcgccaataagtgctgtcacgtgggctgcaccaagagaagcctggccagattttgc

SEQ ID NO: 255 - DNA, 1257 bp, Artificial Sequence
  Synthetic Polynucleotide
atgccccggctgttcttcttccacctcctcggcgtgtgcctcctcctcaatcagttctccagggccgtcgccgactcctggatggaggaggtgatcaagctctgcgggcgcgagctcgtgagagcccagattgccatctgcggcatgtccacctggagcgagcccaagagcagcgacaagacccacacctcccctcccagccccgcgccggagctgctgggcggcagcagcgtgtttctgttccctcccaagcccaaggacaccctgtacatcactagggagcccgaggtgacctgcgtggtcgtggatgtgagccacgaagatccagaggtgaagttcaattggtacgtcgacggcgtggaggtgcacaatgccaagaccaagcccagggaggagcagtacaacagcacctacagggtcgtttccgtgctcaccgtgctgcaccaggactggctgaacggcaaggagtacaagtgcaaggtcagcaacaaagccctacccgcccccatcgagaagacaatcagcaaagccaagggccagcccagggagccccaggtgtataccctcccaccctccagggacgaactgaccaagaatcaggtcagcctgacctgccttgtcaagggcttttaccccagcgacatcgccgtggagtgggagagcaacggccaacccgagaacaattacaagaccaccccgcccgtcctggactccgacgggtccttcttcctatacagcaagctgaccgtggacaagtccagatggcagcaagggaacgtgttctcctgctccgtgatgcacgaggccctgcacaatcactacacgcagaagagtctgagcctgagccccgggaagcggaagaagcgatccctgagccaggaggacgccccgcagacaccccgccccgtggccgagattgtgcccagcttcatcaacaaggacaccgagacgatcaatatgatgtccgagttcgtggccaacctgccacaggaactgaagctgaccctgagcgaaatgcagcctgcgcttccgcagctgcaacaacatgtccccgtgctgaaggacagcagcctgctgtttgaggagttcaagaagctgataaggaaccggcagagcgaggccgccgacagcagccccagcgaactgaagtacctgggcctggacacccacagcagaaagaagaggcaactgtatagcgcactggctaataagtgctgtcacgtgggctgcaccaaacgcagcctggccaggttctgc

SEQ ID NO: 256 - DNA, 1257 bp, Artificial Sequence
  Synthetic Polynucleotide
atgcccagactgttcttcttccacctcctcggggtgtgcctcctcctcaaccagttctccagggccgtggccgacagctggatggaggaggtgatcaagctctgcggcagagagctcgtcagggcccagatcgccatctgcggtatgagcacgtggagcgagcccaagagctccgacaagacccatacaagccccccgagccccgcgcccgaactcctggggggctccagcgtgtttctgttcccgcccaagcccaaagacaccctgtacatcacccgggagcctgaggtgacctgcgtggtggtggacgtgtcccacgaagaccctgaggtgaaattcaactggtacgtggacggcgtggaggtgcataacgccaagaccaaaccgcgtgaggagcaatacaacagcacctaccgggtggtgtcggtgctgaccgtcctgcaccaggactggctgaacggcaaggagtacaagtgtaaggtgtccaacaaggctctccccgcccccatcgagaagaccatctccaaggccaagggccagccccgcgagccccaggtgtacaccctcccgcccagccgcgacgagctgaccaagaaccaggtgtccctgacctgcttggtgaagggcttctaccccagcgacatcgccgtggaatgggagtccaacggccagccggagaacaactacaagaccactccccccgtcctggacagcgacggctccttcttcctgtacagcaagctgaccgtcgacaagtcccgctggcagcaggggaacgtgttctcctgcagcgtgatgcacgaggccctgcacaaccactacactcagaagtctctgtcccttagccccggcaagcggaagaagaggagcctgagccaggaggacgccccccaaacgcctcgccccgtggccgagattgtgcccagcttcatcaacaaggacaccgaaaccatcaatatgatgtccgagttcgtggccaacctgccccaggagctgaagctgaccctgtccgagatgcagcccgccctgccccagctgcagcagcacgtgcccgtgctgaaggacagcagcctgctgttcgaggagtttaagaagctgatcagaaacagacaatccgaggcagccgactcctcccccagcgagctgaaatacctgggcctggacacccattcccggaagaagcggcagctgtacagcgccctcgccaacaagtgctgccacgtgggctgcaccaagagaagcctggccaggttctgc

SEQ ID NO: 257 - DNA, 1257 bp, Artificial Sequence
  Synthetic Polynucleotide
atgccccgcctgttcttcttccacctcctcggcgtgtgtctcctccttaaccagttctcccgtgccgtggccgatagctggatggaggaggtgatcaagctctgcggccgagagctcgtgagggcacagatcgccatctgtggcatgtccacctggagcgaacccaagagctccgataagacccacaccagccccccttctcccgcccccgagctgctcggcggcagctcggtgttcctgttcccacccaaacccaaggacaccctctacatcaccagagagcccgaggtaacctgtgtggtcgtggatgtgtcccacgaggaccccgaggtgaagttcaactggtacgtggacggggtggaggtgcacaacgccaagaccaagccccgcgaggagcagtacaacagcacctaccgcgtggtgagcgtgctgacagtgctgcaccaggattggctgaacggcaaggagtacaagtgcaaggtgagcaataaggccctgcccgcccccatcgagaagaccatcagcaaggccaaagggcagcccagagaaccccaggtgtacaccctgccccccagccgggacgagctgaccaagaaccaagtgagcctcacctgcctggtgaaggggttctaccccagcgacatcgccgtggagtgggagagcaacggccagcccgagaacaactacaagaccacgcctcccgtgctggactccgacgggagcttcttcctgtacagcaagctgaccgtggacaagagccgctggcaacaggggaacgtgtttagctgtagcgtcatgcacgaggccctgcacaatcactacacccagaagtccctgagcctgtcccccggcaagaggaagaagcgttccctgagccaggaggacgccccccagacacccaggccggtcgcagagatcgtgccctccttcatcaacaaggacaccgagacaatcaacatgatgagcgagttcgtggccaacctgccccaggaactgaagctcaccctgtccgagatgcagcccgccctgccccagctacagcagcacgtacccgtgctgaaggacagcagcctgctgttcgaggagttcaagaagctgataaggaatcgccagtccgaggccgccgactcatcccctagcgagctgaagtacctcggtctggacacccacagccgtaagaagaggcagctgtattccgccctggccaacaaatgctgccatgtgggctgcaccaagagaagcctggcccggttctgc

SEQ ID NO: 258 - DNA, 1257 bp, Artificial Sequence
  Synthetic Polynucleotide
atgccccggcttttcttcttccacttactcggcgtgtgccttctccttaaccagttcagccgggccgtggccgacagctggatggaggaggtgatcaagctctgcggccgggagctcgtgcgggcccagatcgccatctgcggcatgagcacctggagcgagcccaagagcagcgacaagacccacaccagtccaccgtcccctgcccccgagttactgggcggcagcagcgtgttcctgttcccaccaaagcccaaggacaccctgtacatcacccgggagcccgaggtgacctgcgtggtggtggacgtgagccacgaggaccctgaggtcaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgccccgatcgagaagaccatcagcaaggccaagggccagcctcgcgagcctcaggtgtacaccctgccaccaagccgggacgagctgaccaagaaccaggtgagcctgacctgcctggtgaagggcttctaccccagcgacatcgccgtggagtgggagagcaacggccagccagagaacaactacaagaccacaccacccgtgctggacagcgacggcagcttcttcctgtacagcaagctgacagtggacaagagccggtggcagcagggcaacgtgttcagctgcagcgtgatgcacgaggccctacacaaccactacacccagaagtccctgtctctgtcacccggcaagcggaagaagagatccctgagccaggaggacgccccgcagaccccccggccagtggccgagatcgtgcccagcttcatcaacaaggataccgagacgatcaacatgatgagcgagttcgtggccaacctgccccaggagctgaagctcacactgagcgagatgcagcccgccctgccgcaactccagcagcacgtgccagtgctgaaggacagcagcctgctgttcgaggagttcaagaagctgatccggaaccggcagagcgaggccgctgacagctctcctagcgaactgaagtacctgggcctggacacccacagcaggaagaagcggcagctgtactcagccctggccaacaagtgctgccacgtgggctgcactaagagaagcctcgcccggttctgc

SEQ ID NO: 259 - DNA, 1257 bp, Artificial Sequence
  Synthetic Polynucleotide
atgcccagactgttcttcttccacctcctcggcgtgtgcctcctcctcaaccagttcagccgggccgtggccgacagctggatggaggaggtgatcaagctatgcggccgggagctcgtgcgggcccagatcgccatctgcggcatgagcacctggagcgagcccaagagcagcgacaagacccacacctccccgccgtccccagctcccgagctgttaggaggcagcagcgtgttcctgttcccgcctaagcccaaggacaccctgtacatcacccgggagcccgaggtgacctgcgtggtggtggacgtgagccacgaggacccggaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgcacctatcgagaagaccatcagcaaggccaagggccagccaagagagcctcaggtgtacaccctgccacctagccgggacgagctgaccaagaaccaggtgagcctgacctgcctggtgaagggcttctaccccagcgacatcgccgtggagtgggagagcaacggccagcctgagaacaactacaagaccactccacccgtgctggacagcgacggcagcttcttcctgtacagcaagctcaccgtggacaagagccggtggcagcagggcaacgtgttcagctgcagcgtgatgcacgaggctctgcacaaccactacacccagaagagtctgtcgctgagccccggcaagcggaagaagagaagcctgagccaggaggacgccccgcagaccccccggccagtggcagagatcgtgcccagcttcatcaacaaggataccgagacaattaacatgatgagcgagttcgtggccaacctgccccaggagctgaagctgaccctgagcgagatgcagcccgcactgcctcagttgcagcagcacgtgcctgtgctgaaggacagcagcctgctgttcgaggagttcaagaagctgatccggaaccggcagagcgaggccgccgactccagcccatctgaactgaagtacctgggcctggacacccacagccgcaagaagcgccagctgtactctgccctggccaacaagtgctgccacgtgggatgcacaaagcgttccctggcccggttctgc

SEQ ID NO: 260 - DNA, 1257 bp, Artificial Sequence
  Synthetic Polynucleotide
atgccccggcttttcttcttccacctcctcggcgtgtgcctcctcctcaaccagttcagccgggccgtggccgacagctggatggaggaggtgatcaagctttgcggccgggagctcgtgcgggcccagatcgccatctgcggcatgagcacctggagcgagcccaagagcagcgacaagacccacaccagcccacctagcccggcacccgagctcctgggcggcagcagcgtgttcctgttccctccaaagcccaaggacaccctgtacatcacccgggagcccgaggtgacctgcgtggtggtggacgtgagccacgaggaccctgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgccagcccctatcgagaagaccatcagcaaggccaagggccagcctcgcgagcctcaggtgtacaccctgcctccatcccgggacgagctgaccaagaaccaggtgagcctgacctgcctggtgaagggcttctaccccagcgacatcgccgtggagtgggagagcaacggccagccagagaacaactacaagaccacccctcccgtgctggacagcgacggcagcttcttcctgtacagcaagttgaccgtcgacaagagccggtggcagcagggcaacgtgttcagctgcagcgtgatgcacgaagccctacacaaccactacacccagaagtccctgagcttgagccccggcaagcggaagaagcgctccttgtcccaggaggacgccccgcaaaccccccggccagtggccgagatcgtgcccagcttcatcaacaaggatacagagacaattaacatgatgagcgagttcgtggccaacctgccccaggagctgaagctcacactgagcgagatgcagcccgctctgccacagctccagcagcacgtgcctgtgctgaaggacagcagcctgctgttcgaggagttcaagaagctgatccggaaccggcagagcgaggccgccgactcctccccaagcgagctcaagtacctgggcctggacacccacagcagaaagaagaggcagctctacagcgccctggccaacaagtgctgccacgtgggctgtaccaagagaagcctggcccggttctgc

SEQ ID NO: 261 - DNA, 1257 bp, Artificial Sequence
  Synthetic Polynucleotide
atgcccagactgttcttcttccacttattgggcgtgtgcttgcttctcaaccagttcagccgggccgtggccgacagctggatggaggaggtcatcaagctctgcggccgcgagctcgtccgcgcccagatcgccatctgcggcatgtccacctggtccgagcccaagtcctccgacaagacccacacctccccgccttcccctgcacccgagctcctcggcggctcctccgtcttcctcttccctcctaagcccaaggacaccctctacatcacccgcgagcccgaggtcacctgcgtcgtcgtcgacgtctcccacgaggaccctgaggtgaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctgcctgccccaatcgagaagaccatctccaaggccaagggccagccacgggaacctcaggtctacaccctgcctcctagccgcgacgagctcaccaagaaccaggtgtccctcacctgcctcgtcaagggcttctacccttctgatatcgccgtcgagtgggagtccaacggtcagcctgagaacaactacaagaccacccctcccgtcctcgactccgacggctccttcttcctgtactccaagctgaccgtggacaagtcccgctggcagcagggcaacgtcttctcctgctccgtcatgcacgaggctctgcacaaccactacacccagaagtccctgagcctgagccccggcaagcgcaagaagagaagcctgtcacaggaggacgccccccagacccctcgccctgtcgccgagatcgtcccctccttcatcaataaggacacggagacaatcaacatgatgtccgagttcgtcgccaacctgccgcaggagctgaagctcaccctctccgagatgcagcccgcccttcctcagctccagcagcacgtgcctgtcctgaaggactcctccctcctcttcgaggagttcaagaagctcatccgcaaccgccagtccgaggccgccgatagctcgccttccgagctaaagtacctcggcctcgacacccactcccggaagaagaggcagctgtatagcgccctcgccaacaagtgctgccacgtcggctgcaccaagaggagcctggcccgcttctgc

SEQ ID NO: 262 - DNA, 1257 bp, Artificial Sequence
  Synthetic Polynucleotide
atgccccgtctgttcttcttccaccttctcggcgtgtgcctcctactcaaccagttcagccgggccgtggccgacagctggatggaggaggtcatcaagctctgcggccgcgagctcgtccgcgcccagatcgccatctgcggcatgtccacctggtccgagcccaagtcctccgacaagacccacacctcgcctcctagcccagcccccgagctcctcggcggctcctccgtcttcctcttcccaccgaagcccaaggacaccctctacatcacccgcgagcccgaggtcacctgcgtcgtcgtcgacgtctcccacgaggacccagaggtgaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctgccagccccaatcgagaagaccatctccaaggccaagggccaacctagagagcctcaggtctacaccttgcctccaagtcgcgacgagctcaccaagaaccaggtgtccctcacctgcctcgtcaagggcttctacccaagcgacatcgccgtcgagtgggagtccaacggccagcctgagaacaactacaagaccaccccgcccgtcctcgactccgacggctccttcttcctgtactccaagctgaccgtcgacaagtcccgctggcagcagggcaacgtcttctcctgctccgtcatgcacgaggctctgcacaaccactacacccagaagtccctgagcctgagccccggcaagcgcaagaagagaagcctcagccaggaggacgccccccagacccctagaccggtcgccgagatcgtcccctccttcatcaataaggacacagagacaatcaacatgatgtccgagttcgtcgccaatctgcctcaggagcttaagctcaccctctccgagatgcagcccgctttgcctcagctccagcagcacgtgcctgtgctgaaggactcctccctcctcttcgaggagttcaagaagctcatccgcaaccgccagtccgaggccgccgactcaagcccatccgagctgaagtacctcggcctcgacacccactcccggaagaagaggcagctctactccgccctcgccaacaagtgctgccacgtcggctgcaccaagcggtccctcgcccgcttctgc

SEQ ID NO: 263 - DNA, 1257 bp, Artificial Sequence
  Synthetic Polynucleotide
atgccccggttgttcttcttccaccttttgggcgtgtgccttctcttgaaccagttcagccgggccgtggccgacagctggatggaggaggtcatcaagctctgcggccgcgagctcgtccgcgcccagatcgccatctgcggcatgtccacctggtccgagcccaagtcctccgacaagacccacacctctcctccaagccctgcgcccgagctcctcggcggctcctccgtcttcctcttcccaccaaagcccaaggacaccctctacatcacccgcgagcccgaggtcacctgcgtcgtcgtcgacgtctcccacgaggacccagaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctcccagccccaatcgagaagaccatctccaaggccaagggccaacctagagaaccacaggtctacacactccctcctagccgcgacgagctcaccaagaaccaggtgtccctcacctgcctcgtcaagggcttctacccatccgatatcgccgtcgagtgggagtccaacggacagccggagaacaactacaagaccacacctcccgtcctcgactccgacggctccttcttcctgtactccaagctgaccgtggacaagtcccgctggcagcagggcaacgtcttctcctgctccgtcatgcacgaggccctgcacaaccactacacccagaagtccctctccctgagccccggcaagcgcaagaagagaagtcttagccaggaggacgccccccagacccctagaccggtcgccgagatcgtcccctccttcatcaacaaggatacagagacgatcaacatgatgtccgagttcgtcgccaacctgccacaggagctgaagctgacactctccgagatgcagcccgccctgcctcagctccagcagcacgtgccagtgctgaaggactcctcattactcttcgaggagttcaagaagctcatccgcaaccgccagtccgaggccgccgactctagcccttccgagctcaagtacctcggcctcgacacccactcccggaagaagcggcagctgtacagcgccctcgccaacaagtgctgccacgtcggctgcaccaagcggtcccttgcccgcttctgc

SEQ ID NO: 264 - DNA, 1257 bp, Artificial Sequence
  Synthetic Polynucleotide
atgccccggctattcttcttccacttactcggcgtgtgcctcctcttgaaccagttcagccgggccgtggccgacagctggatggaggaggtgatcaagctttgcggccgggagcttgtgcgggcccagatcgccatctgcggcatgagcacctggagcgagcccaagagcagcgacaagacccacaccagccctccttcccctgcccccgagttgctgggaggcagcagcgtgttcctgttcccaccgaagcccaaggacaccctgtacatcacccgggagcccgaggtgacctgcgtggtggtggacgtgagccacgaggacccagaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgccagcccctatcgagaagaccatcagcaaggccaagggccagcctagggagccacaggtgtacaccctgccacctagccgggacgagctgaccaagaaccaggtgagcctgacctgcctggtgaagggcttctaccccagcgacatcgccgtggagtgggagagcaacggccagccggagaacaactacaagaccaccccacccgtgctggacagcgacggcagcttcttcctgtacagcaagctgacggtggacaagagccggtggcagcagggcaacgtgttcagctgcagcgtgatgcacgaggctctgcacaaccactacacccagaagagtttaagcttgtcacccggcaagcggaagaagcggtccctgagccaggaggacgcccctcagacccccagacctgttgccgagatcgtgcccagcttcatcaataaggataccgaaaccatcaacatgatgagcgagttcgtggccaacctgccccaggagctgaagctgaccctgagcgagatgcagcccgccctgcctcagttgcagcagcacgtgcctgtgctgaaggacagcagcctgctgttcgaggagttcaagaagctgatccggaaccggcagagcgaggccgccgactcctcccctagcgagctcaagtacctgggcctggacacccacagcagaaagaagagacagctctacagcgccctggccaacaagtgctgccacgtgggttgcaccaagcgcagcctggcccggttctgc

SEQ ID NO: 265 - DNA, 1257 bp, Artificial Sequence
  Synthetic Polynucleotide
atgccccggttattcttcttccacctcctcggcgtgtgcctcttgctcaaccagttcagccgggccgtggccgacagctggatggaggaggtgatcaagctctgcggccgggagttggtgcgggcccagatcgccatctgcggcatgagcacctggagcgagcccaagagcagcgacaagacccacacctcccctcctagcccggcgcccgagctgctgggaggcagcagcgtgttcctgttccctcctaagcccaaggacaccctgtacatcacccgggagcccgaggtgacctgcgtggtggtggacgtgagccacgaggacccagaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgcccctatcgagaagaccatcagcaaggccaagggccagccacgcgagcctcaggtgtacaccctgccacctagccgggacgagctgaccaagaaccaggtgagcctgacctgcctggtgaagggcttctaccccagcgacatcgccgtggagtgggagagcaacggccagcctgagaacaactacaagaccacccctcccgtgctggacagcgacggcagcttcttcctgtacagcaagctgacggtggacaagagccggtggcagcagggcaacgtgttcagctgcagcgtgatgcacgaggctctgcacaaccactacacccagaagtcactgagcctgtcacccggcaagcggaagaagagaagcctgtcccaggaggacgcacctcagaccccccggcctgtggccgagatcgtgcccagcttcatcaataaggataccgaaaccatcaacatgatgagcgagttcgtggccaacctgccccaggagctgaagctgaccctgagcgagatgcagcccgctctgcctcagcttcagcagcacgtgcctgtcctgaaggacagcagcctgctgttcgaggagttcaagaagctgatccggaaccggcagagcgaggccgccgactctagccctagcgaactcaagtacctgggcctggacacccacagcagaaagaagcgccagctctacagcgccctggccaacaagtgctgccacgtgggatgcaccaagcgaagcctggcccggttctgc

SEQ ID NO: 266 - DNA, 1257 bp, Artificial Sequence
  Synthetic Polynucleotide
atgcccagactcttcttcttccaccttttgggcgtgtgcctcctcctcaaccagttcagccgggccgtggccgacagctggatggaggaggtcatcaagctctgcggccgcgagctcgtccgcgcccagatcgccatctgcggcatgtccacctggtccgagcccaagtcctccgacaagacccacacctccccgcctagccctgcccccgagctcctcggcggctcctccgtcttcctcttccctccaaagcccaaggacaccctctacatcacccgcgagcccgaggtcacctgcgtcgtcgtcgacgtctcccacgaggacccggaggtgaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtatccaacaaggccctgcctgctcctatcgagaagaccatctccaaggccaagggccaacctagagagccacaggtctacaccctgcctccgtcccgcgacgagctcaccaagaaccaggtgtccctcacctgcctcgtcaagggcttctaccctagcgacatcgccgtcgagtgggagtccaacggccagcctgagaacaactacaagaccacccctcccgtcctcgactccgacggctccttcttcctttactccaagctgaccgtcgacaagtcccgctggcagcagggcaacgtcttctcctgctccgtcatgcacgaggccctccacaaccactacacccagaagtccctctcgctctcccccggcaagcgcaagaagagatccctgtcgcaggaggacgccccccagacccctagaccggtcgccgagatcgtcccctccttcatcaataaggacacagaaaccatcaacatgatgtccgagttcgtcgccaacttgccacaggagctgaagctcaccctctccgagatgcagcccgccctcccacagctccagcagcacgtgcctgtcctcaaggactcctccctcctcttcgaggagttcaagaagctcatccgcaaccgccagtccgaggccgccgatagctcaccttccgagctcaagtacctcggcctcgacacccactccagaaagaagcggcagctgtactccgccctcgccaacaagtgctgccacgtcggctgcaccaagagaagcctcgcccgcttctgc

SEQ ID NO: 267 - DNA, 1257 bp, Artificial Sequence
  Synthetic Polynucleotide
atgccccgactgttcttcttccacttgcttggcgtgtgcctcctcttaaaccagttcagccgggccgtggccgacagctggatggaggaggtcatcaagctctgcggccgcgagctcgtccgcgcccagatcgccatctgcggcatgtccacctggtccgagcccaagtcctccgacaagacccacacctctccgccaagcccagctcccgagctcctcggcggctcctccgtcttcctcttccctcctaagcccaaggacaccctctacatcacccgcgagcccgaggtcacctgcgtcgtcgtcgacgtctcccacgaggacccagaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctgcctgcccctatcgagaagaccatctccaaggccaagggccagcctagagagcctcaggtctacaccctgccaccttcgcgcgacgagctcaccaagaaccaggtgtccctcacctgcctcgtcaagggcttctacccatccgacatcgccgtcgagtgggagtccaacggccaacctgagaacaactacaagaccaccccacccgtcctcgactccgacggctccttcttcctgtactccaagctgaccgtggacaagtcccgctggcagcagggcaacgtcttctcctgctccgtcatgcacgaagccctgcacaaccactacacccagaagtccctcagcttgtcccccggcaagcgcaagaagcggtccctgtcccaggaggacgccccccagacccctagacctgtcgccgagatcgtcccctccttcatcaataaggataccgagactatcaacatgatgtccgagttcgtcgccaacctcccacaggagctgaagctcaccctctccgagatgcagcccgctctgccacagctccagcagcacgtccctgtgctcaaggactcctccctcctcttcgaggagttcaagaagctcatccgcaaccgccagtccgaggccgccgactccagccctagcgagctcaagtacctcggcctcgacacccactccaggaagaagagacagctctacagcgccctcgccaacaagtgctgccacgtcggctgcaccaagagaagcctggcccgcttctgc

SEQ ID NO: 268 - DNA, 1257 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcggccgggagctggtgcgggcccagatcgccatctgcggcatgagcacctggagcgagcccaagagcagcgacaagacccacaccagcccccccagccccgcccccgagctgctgggcggcagcagcgtgttcctgttcccccccaagcccaaggacaccctgtacatcacccgggagcccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagcggaagaagcggagcctgagccaggaggacgccccccagaccccccggcccgtggccgagatcgtgcccagcttcatcaacaaggacaccgagaccatcaacatgatgagcgagttcgtggccaacctgccccaggagctgaagctgaccctgagcgagatgcagcccgccctgccccagctgcagcagcacgtgcccgtgctgaaggacagcagcctgctgttcgaggagttcaagaagctgatccggaaccggcagagcgaggccgccgacagcagccccagcgagctgaagtacctgggcctggacacccacagccggaagaagcggcagctgtacagcgccctggccaacaagtgctgccacgtgggctgcaccaagcggagcctggcccggttctgc

SEQ ID NO: 269 - DNA, 1257 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcgggagggagctggtgagggcgcagatcgcgatctgcgggatgagcacgtggagcgagccgaagagcagcgacaagacgcacacgagcccgccgagcccggcgccggagctgctgggggggagcagcgtgttcctgttcccgccgaagccgaaggacacgctgtacatcacgagggagccggaggtgacgtgcgtggtggtggacgtgagccacgaggacccggaggtgaagttcaactggtacgtggacggggtggaggtgcacaacgcgaagacgaagccgagggaggagcagtacaacagcacgtacagggtggtgagcgtgctgacggtgctgcaccaggactggctgaacgggaaggagtacaagtgcaaggtgagcaacaaggcgctgccggcgccgatcgagaagacgatcagcaaggcgaaggggcagccgagggagccgcaggtgtacacgctgccgccgagcagggacgagctgacgaagaaccaggtgagcctgacgtgcctggtgaaggggttctacccgagcgacatcgcggtggagtgggagagcaacgggcagccggagaacaactacaagacgacgccgccggtgctggacagcgacgggagcttcttcctgtacagcaagctgacggtggacaagagcaggtggcagcaggggaacgtgttcagctgcagcgtgatgcacgaggcgctgcacaaccactacacgcagaagagcctgagcctgagcccggggaagaggaagaagaggagcctgagccaggaggacgcgccgcagacgccgaggccggtggcggagatcgtgccgagcttcatcaacaaggacacggagacgatcaacatgatgagcgagttcgtggcgaacctgccgcaggagctgaagctgacgctgagcgagatgcagccggcgctgccgcagctgcagcagcacgtgccggtgctgaaggacagcagcctgctgttcgaggagttcaagaagctgatcaggaacaggcagagcgaggcggcggacagcagcccgagcgagctgaagtacctggggctggacacgcacagcaggaagaagaggcagctgtacagcgcgctggcgaacaagtgctgccacgtggggtgcacgaagaggagcctggcgaggttctgc

SEQ ID NO: 270 - DNA, 1257 bp, Artificial Sequence
  Synthetic Polynucleotide
atgccccggctgttcttcttccacctgctgggcgtgtgcctgctgctgaaccagttcagccgggccgtggccgacagctggatggaggaggtcatcaagctctgcggccgcgagctcgtccgcgcccagatcgccatctgcggcatgtccacctggtccgagcccaagtcctccgacaagacccacacctcccccccctcccccgcccccgagctcctcggcggctcctccgtcttcctcttcccccccaagcccaaggacaccctctacatcacccgcgagcccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagcgcaagaagcgctccctctcccaggaggacgccccccagaccccccgccccgtcgccgagatcgtcccctccttcatcaacaaggacaccgagaccatcaacatgatgtccgagttcgtcgccaacctcccccaggagctcaagctcaccctctccgagatgcagcccgccctcccccagctccagcagcacgtccccgtcctcaaggactcctccctcctcttcgaggagttcaagaagctcatccgcaaccgccagtccgaggccgccgactcctccccctccgagctcaagtacctcggcctcgacacccactcccgcaagaagcgccagctctactccgccctcgccaacaagtgctgccacgtcggctgcaccaagcgctccctcgcccgcttctgc

SEQ ID NO: 271 - DNA, 1257 bp, Artificial Sequence
  Synthetic Polynucleotide
atgccccgcctgttcttcttccacctcctcggcgtctgcctcctcctcaaccagttctcccgcgccgtggcggacagctggatggaggaggtgatcaagctctgcggccgcgagctcgtgcgcgcccagatcgccatttgcggcatggagcccaagagctccgacaagacccacaccagcccgcccagccccgcccctgagctgctgggcggatccagcgtcttcctgtttccccccaagcccaaggacaccctgtacatcacaagggagcccgaggtcacctgcgtggtggtggacgtcagccacgaggaccccgaggtgaaatttaactggtacgtagacggcgtggaggtgcacaacgccaagaccaagcccagggaggagcagtacaacagcacctaccgggtggtaagcgtcctgaccgtgctgcaccaggactggctgaacggcaaggagtataagtgcaaagtgagcaacaaggccctgcccgcccccatcgagaagaccatcagcaaggccaaggggcagccccgggagccacaggtgtacaccctgccccccagcagggacgagctgaccaagaaccaggtgagtctcacatgcctggttaagggcttctacccatccgacatcgccgtggagtgggaaagcaacggtcagcccgagaacaactacaagaccacgcccccggtgctggactccgacggcagcttcttcctgtactccaagctcaccgtggacaagtccaggtggcagcaggggaacgtgttcagctgcagcgtgatgcatgaggcactgcacaaccactacacgcagaagtccctgtctctgagcccaggcaagcgcaagagcacctggagcaagaggtccctgagccaagaggacgccccccagaccccccggcctgtggccgagatcgtgcccagcttcatcaacaaggacaccgagacgatcaacatgatgagcgaatttgtggccaatctgccccaggagctgaagctcaccctctccgaaatgcagcccgccctcccccaactgcaacaacacgtccccgtgctgaaggacagcagcctgctgtttgaggaatttaagaagctcatcagaaacagacagagcgaggccgcggactccagccccagcgagctgaagtacctgggcctggacacccatagcaggaagaagcggcagctgtacagcgccctcgccaacaagtgctgccacgtgggctgcaccaagagaagcctggccaggttctgc

SEQ ID NO: 272 - DNA, 1257 bp, Artificial Sequence
  Synthetic Polynucleotide
atgccccgactcttcttcttccacctcctcggcgtgtgcctcctcctcaaccagttctctcgagccgtggccgattcctggatggaggaggtgatcaagctctgcggcagagaactcgtgagagcccagatcgccatttgtgggatggagcccaagagcagcgacaagacccatactagcccaccctcccccgcccccgagctgctggggggcagcagcgtgttcctgtttcccccgaagcccaaggacaccctgtacatcacccgggagcccgaggtgacctgcgtggttgtcgacgtgtcacacgaagaccccgaggtgaagttcaactggtacgtggacggcgtcgaggtgcacaacgccaagaccaagcccagggaggagcagtacaacagcacgtacagagtggtgtcagtcctgaccgtcctccaccaggattggctcaacggcaaagagtacaagtgcaaggtgagcaacaaggccctgcccgcccccatcgagaagacaatctccaaggccaagggccagccgagggagccccaggtgtataccctgcccccctcaagggacgagctgaccaagaatcaggtgtccctcacatgcctggtgaaggggttctaccccagcgacatcgccgtggagtgggagagcaacggacagcccgagaacaactacaagaccacaccccccgtgctggacagcgatggaagtttcttcctgtatagcaaactgaccgtggacaaatcacggtggcagcagggcaacgtgttcagctgcagcgtgatgcacgaagccctgcacaaccactacacccagaagtcattatctctgagccccggcaagagaaagagcacgtggagcaagaggagcctctcccaggaggacgccccccagaccccccggcccgtggccgagatcgtgccctcctttattaacaaggacaccgagacaatcaacatgatgtccgagttcgtcgccaatctgccccaggagctcaagctcaccctgagcgagatgcagcccgctctgccccagctgcagcaacacgtgcccgtgctgaaggacagcagcctgctgttcgaggagttcaagaagctgatccgcaaccggcaaagcgaggccgctgacagctcgcccagcgagctgaagtacctggggctggacacccacagccggaagaagcggcagctgtacagcgccctggccaacaagtgctgccacgtggggtgcactaagcggagcctggccagattttgc

SEQ ID NO: 273 - DNA, 1257 bp, Artificial Sequence
  Synthetic Polynucleotide
atgcccagactgttcttctttcacctcctcggcgtgtgtcttttactcaaccaatttagcagagccgtggccgactcttggatggaggaggtgatcaagctctgtggccgcgagcttgtccgggcccagatcgctatctgcggaatggagcccaagtcctccgacaagacccacacctccccacccagtcccgcccccgagctgctcgggggcagcagcgtgttcctgttccctcctaagcccaaggacacgctgtacatcaccagggagcccgaggtcacctgcgtggtggtggacgtgtcccatgaggaccccgaggtgaagttcaactggtacgtggacggcgtggaggttcacaacgctaagaccaagccccgcgaggaacagtacaacagcacctatcgggtcgtgtcagttctgaccgtcctccaccaggactggctgaacggcaaggagtacaagtgcaaggtgagcaacaaagccctccccgccccgatcgagaagaccatcagcaaggccaagggccagccccgagagccccaggtgtacacccttccccccagcagggacgagctcacaaagaatcaggtgagcctgacctgcctggtgaagggcttctacccctccgacatcgcggtggaatgggagagcaacggccagccggagaacaactataagacaacaccccccgtgctggacagcgacggcagcttcttcctctacagcaagctgaccgtcgacaagtccagatggcagcagggcaacgtgttcagctgctccgtgatgcacgaagccctgcacaatcactacactcagaaatccctgtccctgagccccggcaagcggaagtccacctggagtaagcggagtctgagccaggaggacgccccccaaaccccccgacccgtggccgagatcgtgccctccttcatcaataaggacaccgagactatcaacatgatgagcgagttcgtggccaacctgccccaggagctgaagctgacgctgtctgagatgcagcctgccctgccccagctgcagcagcacgtgccagtgctgaaggacagcagcctgctgttcgaggagtttaagaagctaatcagaaaccgccagtccgaggccgccgacagcagcccctccgagctcaagtacctgggcctggacacccattcccgcaagaagaggcagctgtactcggccctggccaacaagtgctgtcacgtcggatgtaccaagagaagtctggccaggttctgc

SEQ ID NO: 274 - DNA, 1257 bp, Artificial Sequence
  Synthetic Polynucleotide
atgccgcggcttttcttcttccacctcctcggcgtgtgcctactccttaaccaattctcccgagccgtcgccgacagctggatggaggaggtgatcaaactctgcggcagggagctcgtgagggcccagatagccatctgcggcatggaacccaagtccagcgacaagacccacaccagcccgcccagccccgcccccgagctgctgggcggctcaagcgtgttcctgttcccgcccaagcccaaggacaccctgtacatcaccagagagccggaggtcacctgcgtggtggtggacgtgtctcacgaggaccccgaagtcaagttcaactggtacgtggatggcgtggaggtgcacaatgcaaagaccaagccgagagaggaacagtacaactcgacgtaccgggtcgtgagcgtcctgaccgtgctgcaccaggactggctgaatggcaaggagtacaagtgcaaagtgtcgaataaggccctgcccgcccccatcgagaagaccatctccaaggccaagggccagcccagagaaccgcaggtatacaccctgcccccttcccgggacgagctgaccaagaaccaggtgtctctcacgtgcctggtgaagggcttctaccccagcgacatcgccgtggagtgggagtccaatggtcagcccgagaacaactataagaccacgccgcccgtgctggactcagacggctccttcttcctctacagcaaactgacggtggacaagagccggtggcagcagggcaacgtgttctcctgcagcgtcatgcacgaggccctgcacaaccactacactcagaagtccctgagcctgagccccgggaagcgaaagtctacctggagcaagcggagcctgagccaagaggacgccccccaaacaccccggcccgtggccgagatagtgcctagcttcattaacaaggacaccgagactatcaacatgatgagcgagttcgtggcgaacctgccccaggagctgaagctgaccctgtccgagatgcagccggccctgcctcagctgcagcagcacgtgcccgtgctgaaggacagcagcctgctgtttgaggagttcaagaagctgatccgcaaccgccaaagcgaagccgccgactccagccctagcgagctcaagtacctgggcctggacacgcacagcaggaagaagaggcagctgtacagcgccctggccaacaagtgctgccacgtcgggtgcaccaagaggagcctggctaggttttgc

SEQ ID NO: 275 - DNA, 1257 bp, Artificial Sequence
  Synthetic Polynucleotide
atgccccgcctgttcttcttccacctccttggcgtgtgcctcctcctaaatcagttcagccgcgccgtggccgacagctggatggaggaggtgatcaagctctgcgggagggagctcgtgcgggcccagatcgccatctgcggcatggagcccaagtccagcgacaagacccacacctcgccccccagccccgcccccgagctgctgggcgggagcagcgttttcctgtttccacctaagcccaaggacactctgtacatcaccagagagcccgaggtcacatgcgtggtggtggacgtgagccacgaggaccccgaggtgaagttcaactggtacgtcgatggcgtcgaggtgcacaacgccaagaccaagcccagggaggagcagtacaacagcacctacagagtggtgtccgtgctgaccgtgctgcaccaggactggctgaacggaaaggagtacaagtgcaaggtgagcaacaaggccctgcccgcgccgatcgagaagaccataagcaaggccaagggccaaccgagggagccccaggtgtacaccctgccccccagcagagacgagctgaccaagaaccaggtgagcctgacctgcctggtcaagggcttctaccccagcgatatcgccgtggaatgggagtccaacggacagccggagaacaactacaagaccacgccccccgtgctcgacagcgacgggtccttcttcctgtactcgaagctgaccgtggacaagagccgctggcagcagggcaacgtgttcagctgctccgtgatgcatgaggccctgcacaaccactatacgcagaagtcgctcagcctgagccccggcaagcgaaagagcacctggagcaagcgaagccttagccaggaggatgccccccagacaccccggccagtggctgagatcgtccccagcttcatcaacaaagacactgagacaattaatatgatgagcgagttcgtggccaatctgccccaggagctcaagctgaccctcagcgagatgcagcccgctctgccccagctgcaacagcacgttcccgtgctgaaggacagctctctgctgttcgaggagttcaagaagctgatcaggaaccgacagagcgaggccgccgactccagcccctcggagctcaaatacctcggcctcgacacccacagcaggaagaagaggcagctgtacagcgccctggccaacaagtgctgccacgtcggctgcaccaagaggtcactcgccaggttctgc

SEQ ID NO: 276 - DNA, 1257 bp, Artificial Sequence
  Synthetic Polynucleotide
atgcccaggctgttcttcttccacctcctcggcgtgtgcctcctcctcaatcagttcagcagagccgtggccgatagctggatggaggaggtcattaagctctgcggcagagagctcgtgcgagcccagatcgccatctgcggcatggagcccaagagcagcgataagacccatacctctcctcccagccccgcccccgagctgctgggcggctcctccgtgttcctgttccctcccaagcccaaagacaccctgtacatcaccagagaacccgaggtgacctgtgtcgtggtggacgtgagccacgaggacccggaggtgaagttcaattggtacgtggatggtgtcgaggtgcacaacgccaagacgaagcccagggaggagcagtataacagcacttatcgcgtggtcagcgtgctgaccgtcctgcaccaagactggctgaacggtaaggagtataagtgcaaggtcagcaacaaagccctgcccgctcccatcgagaagacgatcagcaaggccaagggccagcccagggagccccaggtgtacactctgccccccagcagagacgagctgaccaagaatcaggtgagcctgacctgcctggtgaaggggttctaccccagcgacatcgccgtcgagtgggagagcaacggccagcccgagaacaactataagaccacacccccggtgctggactccgacggaagcttcttcctgtactccaagctcacagttgacaagagcagatggcagcagggcaatgtgttcagctgcagcgtgatgcacgaggccctccacaaccactacacccagaaatccctcagcctgagccccggcaagaggaagtcgacctggagcaagaggagcctgtcccaggaggacgccccccaaacgccccggccggtggccgagatcgtccccagcttcatcaacaaggacaccgagactataaacatgatgagcgagttcgtggccaacctgccccaggagctcaagctgaccctgagcgagatgcagcccgcactgccccaactgcagcagcacgtgcccgtgctgaaggacagcagcctcctgttcgaggagttcaagaagctgatcaggaacaggcagagcgaggccgccgacagcagccccagcgagctgaagtacctgggactggacacccacagccggaagaagcgccagctctacagcgccctggccaacaagtgctgccatgtggggtgcaccaagcggtccctggcccggttctgc

SEQ ID NO: 277 - DNA, 1257 bp, Artificial Sequence
  Synthetic Polynucleotide
atgccccgactgttcttcttccacctcctcggcgtgtgtctcttgcttaatcagttcagccgcgccgtcgccgactcctggatggaggaagtgatcaagctctgtggccgggagctcgtgcgggctcagattgcaatctgcgggatggagcccaagtcgtccgacaagacccacaccagcccgccctcgcccgcccccgagctgcttggcggcagcagcgtgttcctgtttccccccaagcccaaggacaccctgtacatcacccgggaacccgaggtgacctgcgtcgtggtggacgtgtcccacgaggaccccgaggtcaagttcaactggtacgtggacggcgtggaggtgcacaatgccaagaccaagcccagggaggagcaatacaactccacctatcgggtggtgagcgtgctgaccgtgctgcaccaggactggctgaacggcaaggagtacaagtgcaaggtgtcaaacaaggcgctgcccgcccccatcgagaagacaatctccaaggccaagggccagccccgggagccccaggtgtacaccctgccccccagccgggacgagctgaccaagaaccaggttagccttacatgcctggtcaagggcttctacccctccgacatcgccgtggagtgggagtccaacggccagcccgagaacaactacaagaccacaccccccgtgctggactccgacggctccttcttcctttactctaagctgaccgtggacaagagccgctggcaacagggcaatgtcttctcctgctccgtgatgcacgaggccctgcacaatcactacacccagaagtccctgagcctgtcccctggaaagcggaagtccacctggagcaagaggagcctgtcccaggaggatgcccctcagacccccaggcccgtggccgagatcgtgccttcatttattaacaaggacaccgagacgatcaacatgatgtccgagtttgtggccaacctgccccaggagctgaagctcaccctcagcgaaatgcagcccgccctgccccagctgcagcagcacgtgcccgtgctgaaggactcctcgctgctctttgaggagtttaagaagctgatccggaacaggcagagcgaggccgcagattccagcccctcggagctgaagtacctgggcctggacacccacagccggaagaagcgtcagctgtacagcgccctggccaacaaatgttgtcacgtgggctgcactaagaggagcctggccagattttgt

SEQ ID NO: 278 - DNA, 1257 bp, Artificial Sequence
  Synthetic Polynucleotide
atgccccggttattcttcttccacttgcttggcgtgtgcctcctcctcaaccagttcagccgggccgtggccgacagctggatggaggaggtgatcaagctatgcggccgggagctcgtgcgggcccagatcgccatctgcggcatggagcccaagagcagcgacaagacccacacctccccaccatcccctgcccccgagctgctgggaggcagcagcgtgttcctgttcccacctaagcccaaggacaccctgtacatcacccgggagcccgaggtgacctgcgtggtggtggacgtgagccacgaggaccctgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgcccctatcgagaagaccatcagcaaggccaagggccagcctcgggagccacaggtgtacaccctgcctccttcccgggacgagctgaccaagaaccaggtgagcctgacctgcctggtgaagggcttctaccccagcgacatcgccgtggagtgggagagcaacggtcagcctgagaacaactacaagaccactccacccgtgctggacagcgacggcagcttcttcctgtacagcaagcttaccgtcgacaagagccggtggcagcagggcaacgtgttcagctgcagcgtgatgcacgaagccctgcacaaccactacacccagaagagtctgtcactgagccccggcaagaggaagtccacctggtcaaagcggagcctgagccaggaggacgctcctcaaaccccccggccagtggccgagatcgtgcccagcttcatcaataaggacacagagacaatcaacatgatgagcgagttcgtggccaacctgccccaggagctgaagctgacgctcagcgagatgcagcccgccctccctcaactacagcagcacgtgccggtgctgaaggacagcagcctgctgttcgaggagttcaagaagctgatccggaaccggcagagcgaggccgctgacagctccccttccgagcttaagtacctgggcctggacacccacagccggaagaagaggcagctgtacagtgccctggccaacaagtgctgccacgtgggctgcactaagaggtcactggcccggttctgc

SEQ ID NO: 279 - DNA, 1257 bp, Artificial Sequence
  Synthetic Polynucleotide
atgccccggcttttcttcttccacttactcggcgtgtgccttctccttaaccagttcagccgggccgtggccgacagctggatggaggaggtgatcaagctctgcggccgggagctcgtgcgggcccagatcgccatctgcggcatggagcccaagagcagcgacaagacccacaccagccctcctagtcctgcgcccgagctgcttggcggcagcagcgtgttcctgttcccaccgaagcccaaggacaccctgtacatcacccgggagcccgaggtgacctgcgtggtggtggacgtgagccacgaggacccggaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgccccaatcgagaagaccatcagcaaggccaagggccaaccacgagagccgcaggtgtacaccctgcctcctagccgggacgagctgaccaagaaccaggtgagcctgacctgcctggtgaagggcttctaccccagcgacatcgccgtggagtgggagagcaacggtcagcctgagaacaactacaagaccacacctcccgtgctggacagcgacggcagcttcttcctgtacagcaagctgacagttgacaagagccggtggcagcagggcaacgtgttcagctgcagcgtgatgcacgaggccctgcacaaccactacacccagaagagtctgtctctgtcccctggcaagaggaagtccacctggtccaagaggtccctgagccaggaggacgccccgcagaccccccggcctgtggctgagatcgtgcccagcttcatcaataaggataccgagacaatcaacatgatgagcgagttcgtggccaatttgccacaggagctgaagctgacgctgagcgagatgcagcccgccctgccgcagctccagcaacacgtgcctgtcctgaaggacagcagcctgctgttcgaggagttcaagaagctgatccggaaccggcagagcgaggccgccgactcttctccgtccgaactgaagtacctgggcctggacacccacagccggaagaagcggcagctctactccgccctggccaacaagtgctgccacgtgggatgcaccaagcgaagcctggcccggttctgc

SEQ ID NO: 280 - DNA, 1257 bp, Artificial Sequence
  Synthetic Polynucleotide
atgccccggttattcttcttccacttattaggcgtgtgcttactcctcaaccagttcagccgggccgtggccgacagctggatggaggaggtgatcaagctctgcggccgggagttggtgcgggcccagatcgccatctgcggcatggagcccaagagcagcgacaagacccacaccagccctcctagccctgcccccgagctgctgggaggcagcagcgtgttcctgttccctccgaagcccaaggacaccctgtacatcacccgggagcccgaggtgacctgcgtggtggtggacgtgagccacgaggaccctgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgccagctcctatcgagaagaccatcagcaaggccaagggccagcctagagagcctcaggtgtacaccctgccgccaagccgggacgagctgaccaagaaccaggtgagcctgacctgcctggtgaagggcttctaccccagcgacatcgccgtggagtgggagagcaacggacagcctgagaacaactacaagaccaccccacccgtgctggacagcgacggcagcttcttcctgtacagcaagctcaccgtggacaagagccggtggcagcagggcaacgtgttcagctgcagcgtgatgcacgaagccctgcacaaccactacacccagaagtccctatctctgagccccggcaagagaaagtccacctggagcaagagaagtctgagccaggaggacgctccacagaccccccggccagtggccgagatcgtgcccagcttcatcaacaaggatacagaaaccattaacatgatgagcgagttcgtggccaacctgccccaggagctgaagctgacactgagcgagatgcagcccgctctgcctcagcttcagcagcacgtgcctgtgctgaaggacagcagcctgctgttcgaggagttcaagaagctgatccggaaccggcagagcgaggccgccgatagcagccctagtgaactcaagtacctgggcctggacacccacagccggaagaagcggcagctgtatagcgccctggccaacaagtgctgccacgtgggctgcacaaagcgtagcctggcccggttctgc

SEQ ID NO: 281 - DNA, 1257 bp, Artificial Sequence
  Synthetic Polynucleotide
atgccccggcttttcttcttccacctccttggcgtgtgcctcctccttaaccagttcagccgggccgtggccgacagctggatggaggaggtcatcaagctctgcggccgcgagctcgtccgcgcccagatcgccatctgcggcatggagcccaagtcctccgacaagacccacaccagcccgccaagcccagcccccgagctcctcggcggctcctccgtcttcctcttccctccaaagcccaaggacaccctctacatcacccgcgagcccgaggtcacctgcgtcgtcgtcgacgtctcccacgaggacccagaggttaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctgcctgccccaatcgagaagaccatctccaaggccaagggccagcctcgggagcctcaggtctacaccctgccacctagtcgcgacgagctcaccaagaaccaggtgtccctcacctgcctcgtcaagggcttctaccctagcgacatcgccgtcgagtgggagtccaacggccagccagagaacaactacaagaccacccctcccgtcctcgactccgacggctccttcttcctgtactccaagctcactgtggacaagtcccgctggcagcagggcaacgtcttctcctgctccgtcatgcacgaagctctccacaaccactacacccagaagtccctctcactgagccccggcaagcgcaagtccacctggtccaagcggagcctctcgcaggaggacgccccccagacaccacgccctgtcgccgagatcgtcccctccttcatcaataaggacacggagacgatcaacatgatgtccgagttcgtcgccaacctgccacaggagctgaagctgaccctctccgagatgcagcccgccctgccgcagctccagcagcacgtgccagtgctgaaggactcctccctcctcttcgaggagttcaagaagctcatccgcaaccgccagtccgaggccgctgactcaagcccttcagagcttaagtacctcggcctcgacacccactcccgcaagaagcgccagctgtacagcgccctcgccaacaagtgctgccacgtcggctgcacaaagcgaagcctggcccgcttctgc

SEQ ID NO: 282 - DNA, 1257 bp, Artificial Sequence
  Synthetic Polynucleotide
atgcccaggctgttcttcttccacctccttggcgtgtgcctcttactcaaccagttcagccgggccgtggccgacagctggatggaggaggtcatcaagctctgcggccgcgagctcgtccgcgcccagatcgccatctgcggcatggagcccaagtcctccgacaagacccacacctctccaccgagcccagcccccgagctcctcggcggctcctccgtcttcctcttccctcctaagcccaaggacaccctctacatcacccgcgagcccgaggtcacctgcgtcgtcgtcgacgtctcccacgaggacccagaggtgaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctgcctgcccctatcgagaagaccatctccaaggccaagggccagccacgggagccacaggtctacacactgcctccgagccgcgacgagctcaccaagaaccaggtgtccctcacctgcctcgtcaagggcttctaccctagcgacatcgccgtcgagtgggagtccaacggccagccggagaacaactacaagaccaccccgcccgtcctcgactccgacggctccttcttcctgtactccaagctgacagtggacaagtcccgctggcagcagggcaacgtcttctcctgctccgtcatgcacgaggctctgcacaaccactacacccagaagtccctcagcctgtctcccggcaagcgcaagtccacctggtccaagaggagcttgtcccaggaggacgccccccagactccacgccctgtcgccgagatcgtcccctccttcatcaataaggacacagagacgatcaacatgatgtccgagttcgtcgccaaccttcctcaggagctgaagctgaccctctccgagatgcagcccgccctgccgcagctccagcagcacgtgccagtgctcaaggactcctccctcctcttcgaggagttcaagaagctcatccgcaaccgccagtccgaggccgccgacagtagcccttccgagctcaagtacctcggcctcgacacccactcccgcaagaagcgccagctgtattcagccctcgccaacaagtgctgccacgtcggctgcacgaagcggagcctggcccgcttctgc

SEQ ID NO: 283 - DNA, 1257 bp, Artificial Sequence
  Synthetic Polynucleotide
atgcccaggttgttcttcttccaccttttgggcgtgtgcctccttctcaaccagttcagccgggccgtggccgacagctggatggaggaggtcatcaagctctgcggccgcgagctcgtccgcgcccagatcgccatctgcggcatggagcccaagtcctccgacaagacccacacctctcctccgagtccagcacccgagctcctcggcggctcctccgtcttcctcttcccgcctaagcccaaggacaccctctacatcacccgcgagcccgaggtcacctgcgtcgtcgtcgacgtctcccacgaggacccagaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggcccttcctgcccctatcgagaagaccatctccaaggccaagggccagccacgggagcctcaggtctacaccctgcctcctagccgcgacgagctcaccaagaaccaggtgtccctcacctgcctcgtcaagggcttctaccctagcgacatcgccgtcgagtgggagtccaacggtcagcctgagaacaactacaagaccaccccacccgtcctcgactccgacggctccttcttcctttactccaagctgaccgtggacaagtcccgctggcagcagggcaacgtcttctcctgctccgtcatgcacgaggccctgcacaaccactacacccagaagtccctctctctgagccccggcaagcgcaagtccacctggtccaagagatctctcagccaggaggacgccccccagaccccacgcccagtcgccgagatcgtcccctccttcatcaacaaggataccgaaaccatcaacatgatgtccgagttcgtcgccaacctgccacaggagctgaagctcacactctccgagatgcagcccgcgctcccacagctccagcagcacgtgcctgtgctgaaggactcctccctcctcttcgaggagttcaagaagctcatccgcaaccgccagtccgaggccgccgactccagtcctagcgaactgaagtacctcggcctcgacacccactcccgcaagaagcgccagctgtacagcgccctcgccaacaagtgctgccacgtcggctgcacaaagcgcagcctggcccgcttctgc

SEQ ID NO: 284 - DNA, 1257 bp, Artificial Sequence
  Synthetic Polynucleotide
atgccccggcttttcttcttccacctactcggcgtgtgccttctccttaaccagttcagccgggccgtggccgacagctggatggaggaggtgatcaagctctgcggccgggagcttgtgcgggcccagatcgccatctgcggcatggagcccaagagcagcgacaagacccacacctctccgccgagcccagctcccgagctcctgggcggcagcagcgtgttcctgttcccaccaaagcccaaggacaccctgtacatcacccgggagcccgaggtgacctgcgtggtggtggacgtgagccacgaggacccggaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcctgcccctatcgagaagaccatcagcaaggccaagggccagccgcgggagcctcaggtgtacaccctgcctccttctcgggacgagctgaccaagaaccaggtgagcctgacctgcctggtgaagggcttctaccccagcgacatcgccgtggagtgggagagcaacggccagcctgagaacaactacaagaccacccctcccgtgctggacagcgacggcagcttcttcctgtacagcaagttaaccgtggacaagagccggtggcagcagggcaacgtgttcagctgcagcgtgatgcacgaggcactgcacaaccactacacccagaagagtctgagtctcagccccggcaagcggaagtcaacctggagcaagcgaagcctgtcccaggaggacgcccctcagaccccccggcctgtggcggagatcgtgcccagcttcatcaacaaggataccgagacaataaacatgatgagcgagttcgtggccaacctgccccaggagctgaagctgactctgagcgagatgcagcccgccctgccacaattgcagcagcacgtgcctgtgctgaaggacagcagcctgctgttcgaggagttcaagaagctgatccggaaccggcagagcgaggccgccgacagtagccctagcgaacttaagtacctgggcctggacacccacagccggaagaagcggcagctgtactccgccctggccaacaagtgctgccacgtgggctgtaccaagaggagcctggcccggttctgc

SEQ ID NO: 285 - DNA, 1257 bp, Artificial Sequence
  Synthetic Polynucleotide
atgccccggcttttcttcttccacttgctcggcgtgtgcctacttctcaaccagttcagccgggccgtggccgacagctggatggaggaggtgatcaagctctgcggccgggagctcgtgcgggcccagatcgccatctgcggcatggagcccaagagcagcgacaagacccacacctctcctcctagccctgcccccgagctcctgggcggcagcagcgtgttcctgttcccacctaagcccaaggacaccctgtacatcacccgggagcccgaggtgacctgcgtggtggtggacgtgagccacgaggacccagaagtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgccagcccctatcgagaagaccatcagcaaggccaagggacagccaagagagcctcaggtgtacaccctgccacctagccgggacgagctgaccaagaaccaggtgagcctgacctgcctggtgaagggcttctaccccagcgacatcgccgtggagtgggagagcaacggccagcctgagaacaactacaagaccaccccacccgtgctggacagcgacggcagcttcttcctgtacagcaagctcacagtggacaagagccggtggcagcagggcaacgtgttcagctgcagcgtgatgcacgaggccctccacaaccactacacacagaagtccctgagccttagccccggcaagagaaagagcacctggtccaagagaagtctgtcccaggaggacgcccctcagaccccccggccagtggctgagatcgtgcccagcttcatcaacaaggatacagagactatcaacatgatgagcgagttcgtggccaacctgccccaggagctgaagctgaccctgagcgagatgcagcccgcccttccacaactgcagcagcacgtgccagtgctgaaggacagcagcctgctgttcgaggagttcaagaagctgatccggaaccggcagagcgaggccgccgatagcagcccaagcgaactcaagtacctgggcctggacacccacagccggaagaagcggcagctgtacagtgccctggccaacaagtgctgccacgtgggatgcaccaagcggagcctggcccggttctgc

SEQ ID NO: 286 - DNA, 1257 bp, Artificial Sequence
  Synthetic Polynucleotide
atgccccggcttttcttcttccacctcttgggcgtgtgcctcttgctcaaccagttcagccgggccgtggccgacagctggatggaggaggtcatcaagctctgcggccgcgagctcgtccgcgcccagatcgccatctgcggcatggagcccaagtcctccgacaagacccacaccagcccaccttcaccggcccccgagctcctcggcggctcctccgtcttcctcttcccacctaagcccaaggacaccctctacatcacccgcgagcccgaggtcacctgcgtcgtcgtcgacgtctcccacgaggacccagaggtgaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtttccaacaaggccctcccagccccaatcgagaagaccatctccaaggccaagggccagcctcgagagccacaggtctacaccctgccaccttcccgcgacgagctcaccaagaaccaggtgtccctcacctgcctcgtcaagggcttctacccttccgacatcgccgtcgagtgggagtccaacggacaaccagagaacaactacaagaccaccccgcccgtcctcgactccgacggctccttcttcctgtactccaagctgaccgtggacaagtcccgctggcagcagggcaacgtcttctcctgctccgtcatgcacgaggccctgcacaaccactacacccagaagtccctctcactctcccccggcaagcgcaagtccacctggtccaagagatccctgtcccaggaggacgccccccagacaccacgtcctgtcgccgagatcgtcccctccttcatcaacaaggatacagaaaccatcaacatgatgtccgagttcgtcgccaaccttcctcaggagctgaagctcaccctctccgagatgcagcccgccttgccacagctccagcagcacgttcctgtgctcaaggactcctccctcctcttcgaggagttcaagaagctcatccgcaaccgccagtccgaggccgccgactccagccctagcgagctaaagtacctcggcctcgacacccactcccgcaagaagcgccagctctattccgccctcgccaacaagtgctgccacgtcggctgcacaaagagaagcctcgcccgcttctgc

SEQ ID NO: 287 - DNA, 1257 bp, Artificial Sequence
  Synthetic Polynucleotide
atgcccagactcttcttcttccaccttctcggcgtgtgcctccttctcaaccagttcagccgggccgtggccgacagctggatggaggaggtcatcaagctctgcggccgcgagctcgtccgcgcccagatcgccatctgcggcatggagcccaagtcctccgacaagacccacaccagcccacctagcccagcccccgagctcctcggcggctcctccgtcttcctcttccctccgaagcccaaggacaccctctacatcacccgcgagcccgaggtcacctgcgtcgtcgtcgacgtctcccacgaggacccagaggtgaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtgtccaacaaggccctgcctgccccaatcgagaagaccatctccaaggccaagggccagcctagagagcctcaggtctacaccctgcctccaagccgcgacgagctcaccaagaaccaggtttccctcacctgcctcgtcaagggcttctacccttctgacatcgccgtcgagtgggagtccaacggccagccagagaacaactacaagaccacccctcccgtcctcgactccgacggctccttcttcctgtactccaagctgaccgtggacaagtcccgctggcagcagggcaacgtcttctcctgctccgtcatgcacgaggccctccacaaccactacacccagaagtccctctccctctcacccggcaagcgcaagtccacctggtccaagcggtccctgtcccaggaggacgccccccagacccctcggccggtcgccgagatcgtcccctccttcatcaacaaggataccgagacgatcaacatgatgtccgagttcgtcgccaatctcccacaggagctgaagcttaccctctccgagatgcagcccgccctgccgcagctccagcagcacgtgcctgtcctcaaggactcctccctcctcttcgaggagttcaagaagctcatccgcaaccgccagtccgaggccgccgattcctctccttccgagctcaagtacctcggcctcgacacccactcccgcaagaagcgccagctgtattccgccctcgccaacaagtgctgccacgtcggctgcacgaagaggagcctggcccgcttctgc

SEQ ID NO: 288 - DNA, 1257 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcggccgggagctggtgcgggcccagatcgccatctgcggcatggagcccaagagcagcgacaagacccacaccagcccccccagccccgcccccgagctgctgggcggcagcagcgtgttcctgttcccccccaagcccaaggacaccctgtacatcacccgggagcccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctgaccgtgctgcaccaggactggctgaacggcaaggagtacaagtgcaaggtgagcaacaaggccctgcccgcccccatcgagaagaccatcagcaaggccaagggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagcggaagagcacctggagcaagcggagcctgagccaggaggacgccccccagaccccccggcccgtggccgagatcgtgcccagcttcatcaacaaggacaccgagaccatcaacatgatgagcgagttcgtggccaacctgccccaggagctgaagctgaccctgagcgagatgcagcccgccctgccccagctgcagcagcacgtgcccgtgctgaaggacagcagcctgctgttcgaggagttcaagaagctgatccggaaccggcagagcgaggccgccgacagcagccccagcgagctgaagtacctgggcctggacacccacagccggaagaagcggcagctgtacagcgccctggccaacaagtgctgccacgtgggctgcaccaagcggagcctggcccggttctgc

SEQ ID NO: 289 - DNA, 1257 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcgggagggagctggtgagggcgcagatcgcgatctgcgggatggagccgaagagcagcgacaagacgcacacgagcccgccgagcccggcgccggagctgctgggggggagcagcgtgttcctgttcccgccgaagccgaaggacacgctgtacatcacgagggagccggaggtgacgtgcgtggtggtggacgtgagccacgaggacccggaggtgaagttcaactggtacgtggacggggtggaggtgcacaacgcgaagacgaagccgagggaggagcagtacaacagcacgtacagggtggtgagcgtgctgacggtgctgcaccaggactggctgaacgggaaggagtacaagtgcaaggtgagcaacaaggcgctgccggcgccgatcgagaagacgatcagcaaggcgaaggggcagccgagggagccgcaggtgtacacgctgccgccgagcagggacgagctgacgaagaaccaggtgagcctgacgtgcctggtgaaggggttctacccgagcgacatcgcggtggagtgggagagcaacgggcagccggagaacaactacaagacgacgccgccggtgctggacagcgacgggagcttcttcctgtacagcaagctgacggtggacaagagcaggtggcagcaggggaacgtgttcagctgcagcgtgatgcacgaggcgctgcacaaccactacacgcagaagagcctgagcctgagcccggggaagaggaagagcacgtggagcaagaggagcctgagccaggaggacgcgccgcagacgccgaggccggtggcggagatcgtgccgagcttcatcaacaaggacacggagacgatcaacatgatgagcgagttcgtggcgaacctgccgcaggagctgaagctgacgctgagcgagatgcagccggcgctgccgcagctgcagcagcacgtgccggtgctgaaggacagcagcctgctgttcgaggagttcaagaagctgatcaggaacaggcagagcgaggcggcggacagcagcccgagcgagctgaagtacctggggctggacacgcacagcaggaagaagaggcagctgtacagcgcgctggcgaacaagtgctgccacgtggggtgcacgaagaggagcctggcgaggttctgc

SEQ ID NO: 290 - DNA, 1257 bp, Artificial Sequence
  Synthetic Polynucleotide
atgccccggctgttcttcttccacctgctgggcgtgtgcctgctgctgaaccagttcagccgggccgtggccgacagctggatggaggaggtcatcaagctctgcggccgcgagctcgtccgcgcccagatcgccatctgcggcatggagcccaagtcctccgacaagacccacacctcccccccctcccccgcccccgagctcctcggcggctcctccgtcttcctcttcccccccaagcccaaggacaccctctacatcacccgcgagcccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagcgcaagtccacctggtccaagcgctccctctcccaggaggacgccccccagaccccccgccccgtcgccgagatcgtcccctccttcatcaacaaggacaccgagaccatcaacatgatgtccgagttcgtcgccaacctcccccaggagctcaagctcaccctctccgagatgcagcccgccctcccccagctccagcagcacgtccccgtcctcaaggactcctccctcctcttcgaggagttcaagaagctcatccgcaaccgccagtccgaggccgccgactcctccccctccgagctcaagtacctcggcctcgacacccactcccgcaagaagcgccagctctactccgccctcgccaacaagtgctgccacgtcggctgcaccaagcgctccctcgcccgcttctgc

SEQ ID NO: 291 - DNA, 1233 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcggcagcacagactccggctctgataccagctccggcaacagcggcgatggcaattccggccaactctacagtgcattggctaataaatgttgccatgttggttgtaccaaaagatctcttgctagattttgcggcagcacagactccggctctgataccagctccggcaacagcggcgatggcaattccggcggcagctccggaggaggctctggctctagctccggctctagcggcagcggcggctccggcggcagcacagactccggctctgataccagctccggcaacagcggcgatggcaattccggcggcagctccggaggaggctctggctctagctccggctctagcggcagcggcggctccggcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaag

SEQ ID NO: 292 - DNA, 993 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcggcagcacagactccggctctgataccagctccggcaacagcggcgatggcaattccggccaactctacagtgcattggctaataaatgttgccatgttggttgtaccaaaagatctcttgctagattttgcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaag

SEQ ID NO: 293 - DNA, 1053 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcggcagcacagactccggctctgataccagctccggcaacagcggcgatggcaattccggccaactctacagtgcattggctaataaatgttgccatgttggttgtaccaaaagatctcttgctagattttgcggcagcacagactccggctctgataccagctccggcaacagcggcgatggcaattccggcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaag

SEQ ID NO: 294 - DNA, 1317 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgcggcagcacagactccggctctgataccagctccggcaacagcggcgatggcaattccggcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaag

SEQ ID NO: 295 - DNA, 1317 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagagagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccaagccccccagcagggacgagctgaccaagaaccaggtgagcctgtcctgcctggtgaagggcttctaccccagcgacatcgccgtggagtgggagagcaacggccagcccgagaacaactacaagaccaccgtccccgtgctggacagcgacggcagcttccgcctggccagctatctgaccgtggacaagagcaggtggcagcagggcaacgtgttcagctgcagcgtgatgcacgaggccctgcacaaccactacacccagaagagcctgagcctgagccccggcaagaggaagggcagcacagactccggctctgataccagctccggcaacagcggcgatggcaattccggccaactctacagtgcattggctaataaatgttgccatgttggttgtaccaaaagatctcttgctagattttgc

SEQ ID NO: 296 - DNA, 978 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagagaggtgcagctgctggagagcggcggcggcctggtgcagcccggcggcagcctgaggctgagctgcgccgccagcggcttcaccttcagcagctacgccatgagctgggtgaggcaggcccccggcaagggcctggagtgggtgagcgccatcagcggcagcggcggcagcacctactacgccgacagcgtgaagggcaggttcaccatcagcagggacaacagcaagaacaccctgtacctgcagatgaacagcctgagggccgaggacaccgccgtgtactactgcaccaaggacccccccaggtaccactacaccggcctggccgtgaggggccagggcaccaccgtgaccgtgagcagcggcagcacagactccggctctgataccagctccggcaacagcggcgatggcaattccggccaactctacagtgcattggctaataaatgttgccatgttggttgtaccaaaagatctcttgctagattttgc

SEQ ID NO: 297 - DNA, 1317 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagagagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccctgccccccagcagggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcaggtggcagcagggcaacgtgttcagctgcagcgtgatgcacgaggccctgcacaaccactacacccagaagagcctgagcctgagccccggcaagaggaagggcagcacagactccggctctgataccagctccggcaacagcggcgatggcaattccggccaactctacagtgcattggctaataaatgttgccatgttggttgtaccaaaagatctcttgctagattttgc

SEQ ID NO: 298 - DNA, 1317 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgcggcagcacagactccggctctgataccagctccggcaacagcggcgatggcaattccggcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccaagccccccagcagggacgagctgaccaagaaccaggtgagcctgtcctgcctggtgaagggcttctaccccagcgacatcgccgtggagtgggagagcaacggccagcccgagaacaactacaagaccaccgtccccgtgctggacagcgacggcagcttccgcctggccagctatctgaccgtggacaagagcaggtggcagcagggcaacgtgttcagctgcagcgtgatgcacgaggccctgcacaaccactacacccagaagagcctgagcctgagccccggcaagaggaag

SEQ ID NO: 299 - DNA, 978 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgcggcagcacagactccggctctgataccagctccggcaacagcggcgatggcaattccggcgaggtgcagctgctggagagcggcggcggcctggtgcagcccggcggcagcctgaggctgagctgcgccgccagcggcttcaccttcagcagctacgccatgagctgggtgaggcaggcccccggcaagggcctggagtgggtgagcgccatcagcggcagcggcggcagcacctactacgccgacagcgtgaagggcaggttcaccatcagcagggacaacagcaagaacaccctgtacctgcagatgaacagcctgagggccgaggacaccgccgtgtactactgcaccaaggacccccccaggtaccactacaccggcctggccgtgaggggccagggcaccaccgtgaccgtgagcagc

SEQ ID NO: 300 - DNA, 1317 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcggcagcacagactccggctctgataccagctccggcaacagcggcgatggcaattccggcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccaagccccccagcagggacgagctgaccaagaaccaggtgagcctgtcctgcctggtgaagggcttctaccccagcgacatcgccgtggagtgggagagcaacggccagcccgagaacaactacaagaccaccgtccccgtgctggacagcgacggcagcttccgcctggccagctatctgaccgtggacaagagcaggtggcagcagggcaacgtgttcagctgcagcgtgatgcacgaggccctgcacaaccactacacccagaagagcctgagcctgagccccggcaagaggaagaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgc

SEQ ID NO: 301 - DNA, 714 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcggcagcacagactccggctctgataccagctccggcaacagcggcgatggcaattccggccaactctacagtgcattggctaataaatgttgccatgttggttgtaccaaaagatctcttgctagattttgcggcagcacagactccggctctgataccagctccggcaacagcggcgatggcaattccggcgaggtgcagctgctggagagcggcggcggcctggtgcagcccggcggcagcctgaggctgagctgcgccgccagcggcttcaccttcagcagctacgccatgagctgggtgaggcaggcccccggcaagggcctggagtgggtgagcgccatcagcggcagcggcggcagcacctactacgccgacagcgtgaagggcaggttcaccatcagcagggacaacagcaagaacaccctgtacctgcagatgaacagcctgagggccgaggacaccgccgtgtactactgcaccaaggacccccccaggtaccactacaccggcctggccgtgaggggccagggcaccaccgtgaccgtgagcagc

SEQ ID NO: 302 - DNA, 1053 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcggcagcacagactccggctctgataccagctccggcaacagcggcgatggcaattccggccaactctacagtgcattggctaataaatgttgccatgttggttgtaccaaaagatctcttgctagattttgcggcagcacagactccggctctgataccagctccggcaacagcggcgatggcaattccggcgagcccaagagcagcgacaagacccacaccagcccccccagccccgcccccgagctgctgggcggcagcagcgtgttcctgttcccccccaagcccaaggacaccctgtacatcaccagggagcccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgcccgcccccatcgagaagaccatcagcaaggccaagggccagcccagggagccccaggtgtacaccaagccccccagcagggacgagctgaccaagaaccaggtgagcctgtcctgcctggtgaagggcttctaccccagcgacatcgccgtggagtgggagagcaacggccagcccgagaacaactacaagaccaccgtccccgtgctggacagcgacggcagcttccgcctggccagctatctgaccgtggacaagagcaggtggcagcagggcaacgtgttcagctgcagcgtgatgcacgaggccctgcacaaccactacacccagaagagcctgagcctgagccccggcaagaggaag

SEQ ID NO: 303 - DNA, 555 bp, Artificial Sequence; identical to SEQ ID NO: 182
  Synthetic Polynucleotide

SEQ ID NO: 304 - DNA, 924 bp, Artificial Sequence
  Synthetic Polynucleotide
atgccccgcctcttcttcttccacctcctcggcgtgtgcctcctactcaaccagtttagcagggccgtggccgatagctggatggaggaggtgatcaagctctgcggcagagagctcgtgcgggcccagatcgccatctgcggcatgagcacctggagcaagaggagcctgagccaggaggacgccccacaaaccccgcgccccgtggccgagatcgtgcccagcttcatcaacaaggacaccgaaaccatcaacatgatgagcgagtttgtcgccaacctgccccaggagctcaagctgaccctgagcgagatgcagcccgccctgcctcagctgcagcagcacgtgccagtgctgaaagactccagcctgctctttgaagagttcaagaagctgatcaggaacagacagagcgaggccgctgacagcagcccctcagagctgaagtacctggggctggatacccatagccgcaagaagcggcagctgtactccgccctcgccaacaagtgctgccacgtgggctgcaccaagcggagcctcgcccgattctgtggcggcggagggtccggcggcggcggcagcggtggaggcgggagcgacatccagatgacccagagccccagcagcctgtccgccagtgtgggcgatagagtcaccatcacgtgcagggcctccaggcccatcggcaccatgctgagctggtaccagcagaagcccggcaaggcgcccaagctgctgatcctggccttcagcaggctgcagtccggggtgcccagccggttctccggctccggcagcggcaccgactttaccctgaccatcagcagcctgcagcctgaggacttcgccacctactactgcgcccaggccggcacccaccccaccacgttcggtcagggcactaaggtggagatcaagcgg

SEQ ID NO: 305 - DNA, 924 bp, Artificial Sequence; identical to SEQ ID NO: 304
  Synthetic Polynucleotide

SEQ ID NO: 306 - DNA, 924 bp, Artificial Sequence
  Synthetic Polynucleotide
atgccccggctgttcttcttccacctactcggcgtctgcctcctcctaaaccagttttcccgcgccgtggccgactcctggatggaggaggtgatcaagctctgcggcagagagctcgtgagggcccagatcgcgatttgcggcatgtccacctggagcaagaggagcctcagccaggaggacgcgccccaaaccccgaggcccgtggccgagatcgtgccgagctttatcaacaaggacaccgaaaccatcaacatgatgtccgagtttgtggctaatctgccccaggagctcaagctcacactgtccgagatgcagcccgccctgccccaactgcagcagcacgtccccgtgctcaaggacagcagcctcctcttcgaggaattcaagaagctcatccgcaaccggcagagcgaggccgccgacagcagcccctcagagctgaagtacctgggcctcgacacccacagccggaagaagaggcagctgtactccgccctggccaacaaatgctgccatgtgggctgcacaaagaggagcctggcccggttttgcggaggtggtgggagcggcggtggcggttcaggcggcggcggttccgacatccagatgacccagagccccagcagcctgtccgcttccgtgggcgaccgtgtgaccatcacctgccgcgccagccgacccatcggcaccatgctgtcctggtaccagcagaagccggggaaggccccaaagctgctgattctggcctttagccggctgcagagcggggtgcccagcagattcagcggctcggggagcgggaccgactttacgctgaccatcagctccctgcagcccgaggatttcgcaacgtactactgtgcccaggccggcacccaccccactactttcggccagggcaccaaggtggagatcaagcgt

SEQ ID NO: 307 - DNA, 924 bp, Artificial Sequence
  Synthetic Polynucleotide
atgcccaggctgttcttcttccacctcctcggcgtgtgtctcctcctcaaccagttcagcagagccgtcgccgattcttggatggaggaggtgatcaagttgtgcggccgggagctcgtgagggctcagatcgccatctgcggcatgtcaacctggagcaagcggtcgctgagccaggaggacgcccctcagaccccgaggcccgtggccgagatcgtgcctagcttcatcaacaaggacaccgagacaatcaacatgatgagcgagtttgtggcgaatctgccccaggagctgaagctcaccctcagcgagatgcagcccgccctgccccagctgcagcagcacgtgcccgtgctgaaggacagcagcctgctgttcgaggagtttaagaagctgatccggaacaggcagagcgaggccgccgacagcagcccctctgaactgaagtatctcgggctggacacccacagccggaagaagcgccagctgtactccgccctggccaacaaatgctgccacgtggggtgcaccaaacggagcctggcccggttctgtggcggcggcggctccggcggcggtgggtctggaggcggcggctcggatatccagatgacccagagccccagcagcctgtccgcctccgtgggcgacagggtgaccatcacctgccgggcctctaggcccatcgggaccatgctcagctggtaccagcagaaaccaggcaaggcccctaagctgctgatcctggcattcagccgcctgcagagcggcgtcccctccaggttcagcggcagcggtagcggaacggacttcaccctcaccattagctccctccagcccgaggacttcgccacctactactgtgcacaggccggtacccaccccacgaccttcggccagggcacaaaggtggagatcaagcgg

SEQ ID NO: 308 - DNA, 924 bp, Artificial Sequence
  Synthetic Polynucleotide
atgcctaggctgttcttcttccacctcctcggcgtgtgtctcctcctcaaccagttcagccgggccgtggccgactcctggatggaggaggtgatcaagctctgcggcagagagctcgtccgagcccagatagccatctgcggcatgagcacctggagcaagaggagcctgagtcaggaggacgcccctcagacaccccggcccgtggctgagatcgtgcccagcttcattaacaaagacaccgaaaccatcaacatgatgtccgagttcgtggccaatctgccacaggagctcaagctgaccctgagcgagatgcagcccgccctgccccagctgcagcagcacgtgcccgtgctgaaggacagcagcctgctctttgaggagttcaagaagctgatccgcaaccgacagagcgaggctgccgatagcagcccttccgaactcaaatacctgggcctggacacacacagccggaagaagcggcagctgtacagcgccctggctaacaagtgttgccacgtagggtgcaccaaacgcagcctggccagattctgcggcggcggcggctccggcggaggcggatcaggcggcggcggcagcgatatccagatgactcagagccccagctccctgagcgcctccgttggggaccgggtgaccatcacctgcagagcgagccgccccatcggcaccatgctctcctggtaccaacagaagccaggcaaggccccgaagctgctgattctcgccttcagcaggctgcaaagcggcgtgcccagcaggttctccggctccggcagcggcacagacttcaccctgaccatcagctccctgcagccggaggacttcgccacctactattgtgcccaggccggcacccaccccaccaccttcggccaaggcacaaaggtggaaatcaagagg

SEQ ID NO: 309 - DNA, 924 bp, Artificial Sequence
  Synthetic Polynucleotide
atgcccagactcttcttcttccatctactcggtgtgtgtctcctcctcaatcagtttagccgggccgttgccgacagctggatggaggaggtcatcaagctctgcggcagggagctcgtgcgggcccagatcgccatctgcggcatgagcacctggagcaagagatccctgtcgcaggaggacgcgccacagactcctcggcccgtggccgagatcgtgcccagctttatcaacaaggacaccgaaaccatcaacatgatgagcgagttcgtggcaaatctgccccaggagctgaagctgaccctgagcgagatgcagcctgccttgcctcagctgcagcagcatgtgcccgtgctcaaagatagcagcctgctgttcgaggagttcaagaaactgatccggaaccggcagagcgaggccgccgactccagcccctctgagctgaagtacctggggctggacacgcactcccggaagaagagacagctctatagcgccctggccaacaagtgctgtcatgtgggatgcaccaagagaagcctcgcccgcttctgcggaggcggaggcagcggcggtggcggtagcggaggcggcgggtccgacatacagatgacccagagcccctcctccctgagtgcctccgtcggcgaccgggtgaccatcacgtgccgcgccagccggcccatcggcacaatgctgtcctggtaccagcagaagcccgggaaggcgcccaagctgctgatcctggcgttctcccggctgcagtccggcgtgcccagcaggttcagcggctcaggctccggtaccgacttcaccctgactataagcagcctgcagccggaggattttgccacctactactgcgcccaggccggcacccacccaaccaccttcggccagggcaccaaggtggagatcaagcgg

SEQ ID NO: 310 - DNA, 924 bp, Artificial Sequence
  Synthetic Polynucleotide
atgcccaggctgttcttcttccacctcctcggcgtgtgcctcctcctcaaccagttcagccgggccgtggccgacagctggatggaggaggtgatcaagctctgcggccgggagctcgtgcgggcccagatcgccatctgcggcatgagcacctggagcaagcggagcctgagccaggaggacgccccgcagactccgcggccagtggccgagatcgtgcccagcttcatcaacaaggacaccgaaaccatcaacatgatgagcgagttcgtggccaacctgccccaggagctgaagctgaccctgagcgagatgcagcccgctctgccgcagctgcagcagcacgtgcccgtgctgaaggacagcagcctgctgttcgaggagttcaagaagctgatccggaaccggcagagcgaggccgcagattcttctcctagcgagctcaagtacctgggcctggacacccacagccggaagaagcggcagctgtacagcgccctggccaacaagtgctgccacgtgggctgcaccaagaggtcactggcccggttctgcggcggcggtggatctggcggaggaggctcgggaggcggcggcagcgacatccagatgacccagagcccaagctccctgtccgccagcgtgggcgaccgggtgaccatcacctgccgggccagccggcccatcggcaccatgctgagctggtaccagcagaagcccggcaaggccccgaagctgctgatcctggccttctctaggctgcagagcggcgtgccgagccggttctcgggcagcggctccggcaccgacttcaccctgactatctcgagcctccagccggaggacttcgccacctactactgcgcccaggccggcacccaccccaccaccttcggccagggcaccaaggtggagatcaagcgg

SEQ ID NO: 311 - DNA, 924 bp, Artificial Sequence
  Synthetic Polynucleotide
atgcccaggctgttcttcttccacctcctcggcgtgtgcctcctcctaaaccagttcagccgggccgtggccgacagctggatggaggaggtgatcaagctctgcggccgggagctcgtgcgggcccagatcgccatctgcggcatgagcacctggagcaagcggagcctgagccaggaggacgcccctcagacgccacggccggtggccgagatcgtgcccagcttcatcaacaaggacaccgagacaatcaacatgatgagcgagttcgtggccaacctgccccaggagctgaagctgaccctgagcgagatgcagcccgccctgccgcagctgcagcagcacgtgcccgtgctgaaggacagcagcctgctgttcgaggagttcaagaagctgatccggaaccggcagagcgaggccgccgactccagccccagcgaattgaagtacctgggcctggacacccacagccggaagaagcggcagctgtacagcgccctggccaacaagtgctgccacgtgggctgcaccaagaggagtctggcccggttctgcggcggaggcggaagcggtggaggcggctctggcggcggtggctcggacatccagatgacccagagcccgtcctccctgtccgccagcgtgggcgaccgggtgaccatcacctgccgggccagccggcccatcggcaccatgctgagctggtaccagcagaagcccggcaaggccccgaagctgctgatcctggccttcagcaggctgcagagcggcgtgccgagccggttcagcggtagcggctccggcaccgacttcaccctgacaatcagctcgctgcagccagaggacttcgccacctactactgcgcccaggccggcacccaccccaccaccttcggccagggcaccaaggtggagatcaagcgg

SEQ ID NO: 312 - DNA, 924 bp, Artificial Sequence
  Synthetic Polynucleotide
atgcccagactgttcttcttccacctcttgggcgtgtgcctcctcctcaaccagttcagccgggccgtggccgacagctggatggaggaggtcatcaagctctgcggccgcgagctcgtccgcgcccagatcgccatctgcggcatgtccacctggtccaagcgctccctctcccaggaggacgctccgcagaccccgcgccccgtcgccgagatcgtcccctccttcatcaacaaggacaccgagacgatcaacatgatgtccgagttcgtcgccaacctcccacaggagctcaagctcaccctctccgagatgcagcccgccctgccgcagctccagcagcacgtccccgtcctcaaggactcctccctcctcttcgaggagttcaagaagctcatccgcaaccgccagtccgaggccgcggacagcagcccgtccgagctgaagtacctcggcctcgacacccactcccgcaagaagcgccagctctactccgccctcgccaacaagtgctgccacgtcggctgcaccaagaggagcctggcccgcttctgcggcggaggcggcagcggcggcggtggatccggtggcggcggaagcgacatccagatgacccagagcccgagcagcctgagcgcctccgtcggcgaccgcgtcaccatcacctgccgcgcctcccgccccatcggcaccatgctctcctggtaccagcagaagcccggcaaggcccctaagctcctcatcctcgccttctcccgcctccagtccggcgtgccgagccggttctccggaagcggctcgggcaccgacttcaccctcaccatctcctcactccagccggaggacttcgccacctactactgcgcccaggccggcacccaccccaccaccttcggccagggcaccaaggtcgagatcaagcgc

SEQ ID NO: 313 - DNA, 924 bp, Artificial Sequence
  Synthetic Polynucleotide
atgcccagactgttcttcttccacctcctcggcgtgtgcctcctcctcaaccagttcagccgggccgtggccgacagctggatggaggaggtcatcaagctctgcggccgcgagctcgtccgcgcccagatcgccatctgcggcatgtccacctggtccaagcgctccctctcccaggaggacgccccgcagacgccgcgccccgtcgccgagatcgtcccctccttcatcaacaaggacaccgagacaatcaacatgatgtccgagttcgtcgccaacctgccgcaggagctcaagctcaccctctccgagatgcagcccgccctgccgcaactccagcagcacgtccccgtcctcaaggactcctccctcctcttcgaggagttcaagaagctcatccgcaaccgccagtccgaggccgccgactccagcccctccgagctgaagtacctcggcctcgacacccactcccgcaagaagcgccagctctactccgccctcgccaacaagtgctgccacgtcggctgcaccaagcggagcctggcccgcttctgcggcggtggcggaagcggaggcggaggcagcggcggaggtggctccgacatccagatgacccagagccctagctctctgagcgcctccgtcggcgaccgcgtcaccatcacctgccgcgcctcccgccccatcggcaccatgctctcctggtaccagcagaagcccggcaaggccccgaagctcctcatcctcgccttctcccgcctccagtccggcgtgccgtcccggttcagcggctccggcagcggaaccgacttcaccctgacgatcagctccctgcagcctgaggacttcgccacctactactgcgcccaggccggcacccaccccaccaccttcggccagggcaccaaggtcgagatcaagcgc

SEQ ID NO: 314 - DNA, 924 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcggccgggagctggtgcgggcccagatcgccatctgcggcatgagcacctggagcaagcggagcctgagccaggaggacgcaccccagaccccacggcccgtggccgagatcgtgcccagcttcatcaacaaggacaccgagaccatcaacatgatgagcgagttcgtggccaacctgccccaggagctgaagctgaccctgagcgagatgcagcccgccctgccccagctgcagcagcacgtgcccgtgctgaaggacagcagcctgctgttcgaggagttcaagaagctgatccggaaccggcagagcgaggccgccgacagcagccccagcgagctgaagtacctgggcctggacacccacagccggaagaagcggcagctgtacagcgccctggccaacaagtgctgccacgtgggctgcaccaagcggagcctggcccggttctgcggcggcggcggcagcggcggcggcggcagcggcggcggcggcagcgacatccagatgacccagagccccagcagcctgagcgccagcgtgggcgaccgggtgaccatcacctgccgggccagccggcccatcggcaccatgctgagctggtaccagcagaagcccggcaaggcccccaagctgctgatcctggccttcagccggctgcagagcggcgtgcccagccggttcagcggcagcggcagcggcaccgacttcaccctgaccatcagcagcctgcagcccgaggacttcgccacctactactgcgcccaggccggcacccaccccaccaccttcggccagggcaccaaggtggagatcaagcgg

SEQ ID NO: 315 - DNA, 924 bp, Artificial Sequence
  Synthetic Polynucleotide
atgccccggctgttcttcttccacctgctgggcgtgtgcctgctgctgaaccagttcagccgggccgtggccgacagctggatggaggaggtgatcaagctgtgcgggagggagctggtgagggcgcagatcgcgatctgcgggatgagcacgtggagcaagaggagcctgagccaggaggacgcgccgcagacgccgaggccggtggcggagatcgtgccgagcttcatcaacaaggacacggagacgatcaacatgatgagcgagttcgtggcgaacctgccgcaggagctgaagctgacgctgagcgagatgcagccggcgctgccgcagctgcagcagcacgtgccggtgctgaaggacagcagcctgctgttcgaggagttcaagaagctgatcaggaacaggcagagcgaggcggcggacagcagcccgagcgagctgaagtacctggggctggacacgcacagcaggaagaagaggcagctgtacagcgcgctggcgaacaagtgctgccacgtggggtgcacgaagaggagcctggcgaggttctgcggaggcggtgggagcggtggcggagggagcggcggaggcgggagcgacatccagatgacgcagagcccgagcagcctgagcgcgagcgtgggggacagggtgacgatcacgtgcagggcgagcaggccgatcgggacgatgctgagctggtaccagcagaagccggggaaggcgccgaagctgctgatcctggcgttcagcaggctgcagagcggggtgccgagcaggttcagcgggagcgggagcgggacggacttcacgctgacgatcagcagcctgcagccggaggacttcgcgacgtactactgcgcgcaggcggggacgcacccgacgacgttcgggcaggggacgaaggtggagatcaagagg

SEQ ID NO: 316 - DNA, 924 bp, Artificial Sequence
  Synthetic Polynucleotide
atgccccggctgttcttcttccacctgctgggcgtgtgcctgctgctgaaccagttcagccgggccgtggccgacagctggatggaggaggtcatcaagctctgcggccgcgagctcgtccgcgcccagatcgccatctgcggcatgtccacctggtccaagcgctccctctcccaggaggacgcaccccagacaccccgccccgtcgccgagatcgtcccctccttcatcaacaaggacaccgagaccatcaacatgatgtccgagttcgtcgccaacctcccccaggagctcaagctcaccctctccgagatgcagcccgccctcccccagctccagcagcacgtccccgtcctcaaggactcctccctcctcttcgaggagttcaagaagctcatccgcaaccgccagtccgaggccgccgactcctccccctccgagctcaagtacctcggcctcgacacccactcccgcaagaagcgccagctctactccgccctcgccaacaagtgctgccacgtcggctgcaccaagcgctccctcgcccgcttctgcggcggcggcggctccggcggcggcggctccggcggcggcggctccgacatccagatgacccagtccccctcctccctctccgcctccgtcggcgaccgcgtcaccatcacctgccgcgcctcccgccccatcggcaccatgctctcctggtaccagcagaagcccggcaaggcccccaagctcctcatcctcgccttctcccgcctccagtccggcgtcccctcccgcttctccggctccggctccggcaccgacttcaccctcaccatctcctccctccagcccgaggacttcgccacctactactgcgcccaggccggcacccaccccaccaccttcggccagggcaccaaggtcgagatcaagcgc

SEQ ID NO: 317 - DNA, 924 bp, Artificial Sequence
  Synthetic Polynucleotide
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgcggtggcggaggcagcggaggtggtggcagcggcggaggtggcagcgacatccagatgacccagagccccagcagcctgagcgccagcgtgggcgacagggtgaccatcacctgcagggccagcaggcccatcggcaccatgctgagctggtaccagcagaagcccggcaaggcccccaagctgctgatcctggccttcagcaggctgcagagcggcgtgcccagcaggttcagcggcagcggcagcggcaccgacttcaccctgaccatcagcagcctgcagcccgaggacttcgccacctactactgcgcccaggccggcacccaccccaccaccttcggccagggcaccaaggtggagatcaagagg

SEQ ID NO: 318 - DNA, 924 bp, Artificial Sequence; identical to SEQ ID NO: 317
  Synthetic Polynucleotide

SEQ ID NO: 319 - DNA, 924 bp, Artificial Sequence; identical to SEQ ID NO: 163
  Synthetic Polynucleotide

SEQ ID NO: 320 - DNA, 92 bp, Artificial Sequence
  Synthetic Polynucleotide
tcaagcttttggaccctcgtacagaagctaatacgactcactatagggaaataagagagaaaagaagagtaagaagaaatataagagccacc

SEQ ID NO: 321 - DNA, 164 bp, Artificial Sequence
  Synthetic Polynucleotide
tgataatagtccataaagtaggaaacactacagctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 322 - DNA, 119 bp, Artificial Sequence
  Synthetic Polynucleotide
tgataataggctggagcctcggtggccatgcttcttgccccttgggcctccccccagcccctcctccccttcctgcacccgtacccccgtggtctttgaataaagtctgagtgggcggc

SEQ ID NO: 323 - DNA, 141 bp, Artificial Sequence
  Synthetic Polynucleotide
tgataataggctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 324 - DNA, 142 bp, Artificial Sequence
  Synthetic Polynucleotide
tgataataggctggagcctcggtggccatgcttcttgccccttgggcctccccccagcccctcctccccttcctgcacccgtaccccctccataaagtaggaaacactacagtggtctttgaataaagtctgagtgggcggc

SEQ ID NO: 325 - DNA, 829 bp, Homo sapiens
gtcccgacctccaggagagaccaggcccaggatgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctgaaaaaaaaaa

SEQ ID NO: 326 - DNA, 930 bp, Homo sapiens
gtcccgacctccaggagagaccaggcccaggatgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctgaaaaaaaaaa

SEQ ID NO: 327 - RNA, 924 nt, Artificial Sequence
  Synthetic Polynucleotide
augcccagacuguucuucuuccaccuccucggcgugugccuccuccuuaaccaguucagccgggccguggccgacagcuggauggaggaggugaucaagcuaugcggccgggagcucgugcgggcccagaucgccaucugcggcaugagcaccuggagcaagcggagccugagccaggaggacgccccucagaccccgcggccaguggccgagaucgugcccagcuucaucaacaaggacaccgagacaaucaacaugaugagcgaguucguggccaaccugccccaggagcugaagcugacccugagcgagaugcagcccgcccugccgcagcugcagcagcacgugcccgugcugaaggacagcagccugcuguucgaggaguucaagaagcugauccggaaccggcagagcgaggccgccgacuccagccccagcgaacugaaguaccugggccuggacacccacagccggaagaagcggcagcuguacagcgcccuggccaacaagugcugccacgugggcugcaccaagcgaucccuggcccgguucugcggcggcggaggcagcggcgguggcggaagcggaggcggcggcagcgacauccagaugacccagagcccaagcucccuguccgccagcgugggcgaccgggugaccaucaccugccgggccagccggcccaucggcaccaugcugagcugguaccagcagaagcccggcaaggccccgaagcugcugauccuggccuucuccaggcugcagagcggcgugccgagccgguucagcggcuccggcagcggaaccgacuucacccugaccaucucaagccugcagccggaggacuucgccaccuacuacugcgcccaggccggcacccaccccaccaccuucggccagggcaccaagguggagaucaagcgg

SEQ ID NO: 328 - RNA, 555 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 329 - RNA, 519 nt, Artificial Sequence
  Synthetic Polynucleotide
augccuaggcucuuuuucuuccacuugcuaggggugugcuuguuguuaaaccaguuuaguagagcggucgccgauucuuggauggaggaagugauaaagcucugugggcgggaauuaguccgcgcacaaauugccauaugcggaaugggugggggcgguaguggcggaggagguuccgggggaggagggagcggcggaggaggcucaggcggcggaggaagugguggcgguggcucagguggcggaggaucugggggcggcggaagcggcggaggaggaucugggggcgguggaaguggcggaggugggucuggcgggggagggaguggcgggggcgguuccggggguggaggcagcggaggcgguggcuccggggggggugguuccggugguggcgggucaggaggaggggggucaggcggcggaggauccggcggcggcggcucccaacuuuauucggcucuggcuaauaaaugcugucacgugggcugcaccaaacguucgcuugcgcgguuuugu

SEQ ID NO: 330 - RNA, 519 nt, Artificial Sequence
  Synthetic Polynucleotide
augccucgacuguuuuucuuucaccuccuaggagucugcuuacuucucaaccaguucaguagggcagucgcggacucauggauggaagagguuauuaaauuauguggccgugaauuggugcgugcacaaauagcuauuugcggcaugggcgguggcggcucugguggcggcggcucuggagggggcggaagugguggaggagguaguggcggagguggaucgggaggcggaggaucuggaggggggggcuccuuucaaagcuccucgagcaaagcgcccccucccagccugcccagcccuaguaggcugcccgguccgagcgacacgcccauccugccccaggguggcgguggcucuggggguggcgguucaggcggaggugguucuggcggaggcggaucagguggugggggauccggcggcggcggaucugguggcggggggagucagcucuacucugcguuggccaauaaaugcugccauguugguuguacaaaaagaucuuuggcuagauuuugc

SEQ ID NO: 331 - RNA, 1257 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcauggagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaagagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 332 - RNA, 555 nt, Artificial Sequence
  Synthetic Polynucleotide
augcccaggcuguucuucuuccaccugcugggagugugccuccugcugaaccaguucagccgcgccguggccgacagcuggauggaggaggugaucaagcugugcgggagggagcugguccgagcccaaaucgccaucugcgggauguccaccuggagcaagagaagccugucccaggaggaugccccccaaacgcccaggcccguggccgagaucgugcccagcuucaucaacaaggacaccgagaccaucaacaugauguccgaguucguggccaaccugccccaggagcugaagcugacccuguccgagaugcagccagcccucccccagcugcagcagcacgugcccguguugaaggacagcagccugcuguucgaggaguucaaaaagcugauacgcaacaggcagagcgaggcggccgacagcuccccgucggagcugaaguaccuggggcuggacacccacagccggaagaagcggcagcuguacagcgcacuggccaacaaauguugccacgugggcugcaccaagaggagccuggccagguucugc

SEQ ID NO: 333 - RNA, 555 nt, Artificial Sequence
  Synthetic Polynucleotide
augcccaggcuguucuucuuccaccuccugggugugugccugcugcugaaccaguuuagcagggccguggccgacagcuggauggaggaggugaucaagcugugcggcagggagcucgugcgagcgcagaucgccaucugcggcaugagcaccuggaguaagaggagccucucccaggaggacgccccccagacgccacgcccgguggcggagaucgugcccuccuucaucaacaaggacacagagaccaucaacaugaugagcgaguuuguggccaaccugccccaggaacuuaagcugacccucagcgagaugcagccggcccuuccccagcugcagcagcacgugcccgugcugaaggacagcagccugcuguucgaggaguucaaaaagcugauccgcaauaggcagagcgaggccgccgacuccagccccagcgagcugaaguaucugggccuggacacccacagcaggaagaaacggcagcuguacagcgcgcuggcgaacaagugcugccacgugggcugcaccaagaggucgcucgccagguucugc

SEQ ID NO: 334 - RNA, 555 nt, Artificial Sequence
  Synthetic Polynucleotide
augcccaggcuguucuucuuucaccugcugggcgugugucugcugcucaaccaguuuagccgcgccguggccgacagcuggauggaggaggucauaaagcugugcgggagggaacuggugagggcccagaucgccaucugcggaauguccaccuggagcaagaggagccugagccaggaggacgccccacagacuccgcggccgguugcggagaucgugcccuccuucaucaauaaagauaccgagaccaucaacaugauguccgaguucguggccaaccugccgcaggagcugaaacucacccucagcgagaugcagcccgcgcugccccagcugcagcagcacgugcccgugcugaaggacagcagccugcuguuugaagaauucaaaaaacugauccggaaccgacagagcgaggccgccgacuccagccccagcgaacugaaguaccuggggcuggacacccacagccggaaaaagcggcagcuguacagcgcacuggccaauaaguguugccacgucggcugcacgaagcggucccuugcccgcuucugc

SEQ ID NO: 335 - RNA, 555 nt, Artificial Sequence
  Synthetic Polynucleotide
augccccgccuguucuucuuucaccugcugggcgugugccugcugcugaaccaguucagcagggccguggccgacagcuggauggaagaggugaucaagcucugcggcagggaacuggugagggcccagaucgccaucugcggcauguccaccugguccaaaaggagccucagccaggaggacgccccccagaccccccggccaguggccgagaucgugcccuccuucaucaacaaggacaccgagacuaucaacaugauguccgaguucguggccaaccugccccaggagcugaagcugacccugagcgaaaugcagcccgcgcugccccagcugcaacagcacgugcccgugcugaaggacagcagccugcuguuugaggaguucaagaagcugauccgcaacaggcagagcgaggccgccgacuccagccccagcgaacugaaauaucuggggcuggacacccacucccggaagaagaggcagcuguacagcgcccuggccaacaaaugcugccacguggggugcacgaagcggucccuggcccgcuuuugc

SEQ ID NO: 336 - RNA, 555 nt, Artificial Sequence
  Synthetic Polynucleotide
augcccaggcuguuuuucuuccaccuccugggcgugugccugcugcugaaucaguuuucccgggccguggccgacagcuggauggaggaggugaucaagcuguguggccgggagcugguucgggcccagauagccaucuguggaaugagcaccuggagcaagcggagccugucccaggaggacgccccccagacaccccggccgguggccgaaaucguccccagcuucaucaacaaggacaccgagaccaucaacaugaugagcgaguucguggccaaccugccccaggagcugaagcugacgcugagcgagaugcagccugcccugccccagcugcaacagcacgugccugugcugaaggacagcagccuccuguucgaggaguucaagaagcucaucaggaaccggcagagcgaggccgcugacagcucacccagcgagcugaaguaccugggccuggacacccacucgaggaagaagcggcagcuguacagcgcgcuggccaacaaguguugccaugugggcuguaccaagaggagccuggccagguucugc

SEQ ID NO: 337 - RNA, 555 nt, Artificial Sequence
  Synthetic Polynucleotide
augccccgacuguucuuuuuccaccugcugggggugugccugcugcugaaccaguuuucgagggcgguggcggacaguuggauggaggaggucaucaagcucugcgggagggagcucgucagggcccagaucgccaucugcggcauguccaccuggagcaagcguucgcugucccaggaggacgccccccagaccccgagacccguggccgagaucgugcccagcuucaucaacaaggauaccgaaaccaucaacaugaugagcgaguuuguggccaaccucccgcaggagcucaagcucacgcugagcgagaugcagccggcccugccccagcugcagcagcauguccccguccugaaggacagcagccugcuguucgaggaguucaagaaacugauccggaaccggcagagcgaggccgccgauagcagccccagcgagcugaaguaccuggggcuggacacccacagucgcaagaagcggcagcuguacagcgcccuggccaacaaguguugccacgucggguguacgaagcgcucccuggccagauucugc

SEQ ID NO: 338 - RNA, 555 nt, Artificial Sequence
  Synthetic Polynucleotide
augccccggcuguucuuuuuccaccugcugggcgugugccugcugcugaaccaguucagccgagccgucgcagauuccuggauggaggaggugaucaagcugugcggccgggagcucgugagggcccagaucgccauuugcggcauguccaccuggagcaagcggagccugagccaggaggacgcgccgcagacuccccggcccguggccgaaaucgugcccuccuucaucaauaaggacaccgaaaccauaaacaugaugagcgaguuuguggccaaccugccacaggagcugaaacugacgcugagcgagaugcagcccgcgcugccccagcugcagcagcaugugcccgugcugaaggacagcagccugcuguucgaggaauuuaagaagcuaauccggaacaggcagagcgaggccgccgacagcuccccgagcgagcugaaguaccucgggcuggacacccacagccggaagaagcggcaacuguacagcgcccuggcgaacaagugcugccacgugggcuguaccaaaagaagccucgcccgcuucugc

SEQ ID NO: 339 - RNA, 555 nt, Artificial Sequence
  Synthetic Polynucleotide
augccuaggcucuucuucuuccaccugcugggcgucugccugcugcugaaccaauucagccgggccguagccgacuccuggauggaggaggugaucaaacugugcgggagggagcuggugagggcccaaaucgcgaucugcggcauguccaccuggagcaagcggagccugucgcaggaagaugccccccagacccccaggccgguggccgagaucguccccagcuucaucaacaaggauaccgagaccauaaacaugaugagcgaguuuguggccaaccucccccaggagcugaagcugacccucagcgagaugcagcccgcccugccgcagcugcaacagcacgugcccgugcugaaggacagcagccugcuguucgaagaguucaagaagcugauccggaaccggcagagcgaggccgccgacagcucccccuccgagcugaaguaccugggccuggacacgcacagccggaagaagcggcagcuguacagcgcacuggccaacaagugcugucacgucggcugcaccaagcguagccuggccagauucugc

SEQ ID NO: 340 - RNA, 555 nt, Artificial Sequence
  Synthetic Polynucleotide
augcccaggcuguucuucuuccaccugcugggcgugugccugcugcucaaccaguucagcagggccguggccgacagcuggauggaggaggugaucaaacugugcgggagggagcuggugagggcgcagaucgccaucugcggcaugagcaccuggagcaagaggagccucagccaggaggacgccccccagacccccaggcccguggccgagaucgugcccagcuucaucaacaaggacaccgaaaccaucaacaugaugagcgaguucguggccaaccugccccaggagcucaagcugacccucagcgagaugcaacccgcccugccccagcugcagcagcacgugcccgugcugaaggacagcagccugcuguucgaggaguucaagaagcugauccguaacaggcagagcgaggccgccgacuccagccccagcgagcugaaguaccugggccuggacacccacucccggaagaagaggcagcuguacagugcgcuggccaacaaauguugccaugugggcugcaccaagcggagccuggcccgcuucugc

SEQ ID NO: 341 - RNA, 555 nt, Artificial Sequence
  Synthetic Polynucleotide
augcccaggcuguucuuuuuccaccugcugggggucugccuccugcugaaccaguucuccagggcggucgccgacagcuggauggaagaggucaucaagcugugcgggagggagcuggucagggcccagaucgccaucuguggcauguccaccuggagcaagaggagccugagccaggaggacgcgccgcagacgccccgucccguggcggagauagugccgagcuucaucaacaaggacaccgagacuaucaacaugaugagcgaguucguggccaaccucccucaggagcugaagcugacccugagcgagaugcagcccgcccucccccagcugcaacagcacgugcccgugcugaaggacagcagccuccuguucgaggaguucaagaagcugauccggaauaggcagagcgaggccgccgauagcucgcccagcgagcuuaaguaccugggccucgacacacacagcaggaagaagaggcagcuguacagcgcccuggccaacaaguguugccacgucggcugcacuaagcggagccucgcuagguucugc

SEQ ID NO: 342 - RNA, 555 nt, Artificial Sequence
  Synthetic Polynucleotide
augccccgacuguucuucuuccaucugcugggcgugugccuccugcugaaucaauucagcagggccguggccgacuccuggauggaggaggucaucaagcugugcggcagggaacuggugagggcgcagaucgccaucugcggcauguccacuuggagcaagaggucgcugucgcaggaggacgccccccagaccccgaggcccguggccgagaucgugcccagcuucaucaacaaggacaccgagaccaucaauaugauguccgaguucguggccaaccucccucaggagcugaagcugacccuguccgagaugcagcccgcccugccgcagcuucagcagcacgugcccgugcugaaggacagcagccugcuguucgaggaauucaagaagcugauuaggaacaggcaaagcgaggccgccgacuccagcccgagcgagcugaaguaccugggccucgacacccauagccgcaagaagcggcagcuguacucggcccuggcgaacaagugcugccacgugggcugcaccaagcgcagccuggcgcgcuucugc

SEQ ID NO: 343 - RNA, 555 nt, Artificial Sequence
  Synthetic Polynucleotide
augcccaggcuguuuuucuuccaccugcugggggucugccugcugcugaaccaguuuagcagggccguggccgacagcuggauggaggaggugaucaagcugugcggcagggagcuggugcgggcccagaucgccaucugcggcaugagcaccuggagcaagcggucccugagccaggaggacgccccccagacuccccggccgguggccgaaaucgugcccagcuucaucaacaaggacaccgagaccaucaauaugauguccgaguucguggccaaccugccccaggagcugaaacugacccugagcgagaugcagcccgcccugccccagcugcagcagcauguccccgugcugaaggacagcagccuguuguuugaggaguucaaaaaacugauccgaaacaggcagucggaggccgcugacagcucgccaagcgagcugaaguaucuggggcuggacacccacagccgcaagaagaggcagcuguauagcgcgcuggccaacaagugcugccacgugggcugcacgaagaggucccuggccagguucugc

SEQ ID NO: 344 - RNA, 555 nt, Artificial Sequence
  Synthetic Polynucleotide
augcccaggcuguucuucuuccaccugcugggcgugugccugcugcugaaccaguucagcagggccguggccgacagcuggauggaggaggugaucaagcugugcggccgggagcucgugagggcccagaucgcgaucugcggcaugagcaccuggagcaaaaggagucugagccaggaggacgcgccgcagacgcccaggcccgucgccgagaucgugccguccuucaucaacaaggacaccgagaccaucaauaugaugagcgaguucguggccaaccugccccaggagcucaagcugacccugagcgagaugcagcccgcgcugccccagcugcagcagcacgugcccgugcugaaggacuccagccugcuguucgaggaguucaagaaacugaucagaaacaggcagagcgaggccgccgacuccagccccucagagcugaaguaccugggccuggacacccacagcaggaagaagcgccagcucuacagcgcccuggccaacaagugcugccacgucgggugcacaaagaggagccuggccagguucugc

SEQ ID NO: 345 - RNA, 555 nt, Artificial Sequence
  Synthetic Polynucleotide
augccccggcuguucuucuuccaccugcugggcgugugccuccugcugaaccaguucagcagggccguggccgacagcuggauggaggaggugaucaagcugugcggcagggagcuggugagggcgcagaucgccaucugcggcaugagcaccuggagcaagaggagccugagccaggaggacgccccgcaaaccccccggccggucgcggagauagugcccagcuucauaaacaaggacaccgagaccaucaauaugaugagcgaguucguggccaaccugccccaggagcugaagcugacgcugagcgagaugcagccggcccugccgcagcugcagcagcacgugcccgugcugaaggacagcagccuccuguucgaggaguucaagaagcugaucaggaaccggcagagcgaggccgccgacuccagccccagcgagcugaaguaccugggccuggacacccauagcaggaagaagcgccagcuguacagcgcccuggcuaacaagugcugccacgugggcugcaccaagaggagccuggcccgguucugc

SEQ ID NO: 346 - RNA, 555 nt, Artificial Sequence
  Synthetic Polynucleotide
augccccggcuguucuucuuccaccugcucggcgugugccugcugcugaaccaauucagccgggccgucgccgacagcuggauggaggaggugaucaagcugugcggcagggagcuggucagggcccagaucgccaucugugggaugucgaccugguccaagcgcagccugagccaggaggacgccccgcagaccccaagacccguggccgagaucgugcccagcuucaucaacaaagauaccgagaccaucaacaugaugagcgaguucguggccaaccucccccaggagcugaagcugacccucagcgagaugcagcccgcgcugccccagcugcagcagcacgugcccgugcugaaggacagcucccugcuguucgaggaguucaagaagcugauccggaacaggcaguccgaggccgccgacagcagcccgagcgagcugaaguaccuggggcuggacacccacagcaggaagaagcggcagcuguacagcgcccuggccaacaagugcugccacgugggcuguaccaaacgcagccucgccagguucugc

SEQ ID NO: 347 - RNA, 555 nt, Artificial Sequence
  Synthetic Polynucleotide
augcccaggcuguucuucuuccaccugcugggggucugucuccugcugaaccaguucagccgggccguggccgacuccuggauggaggaggugaucaagcugugcgggcgggagcuggugcgggcgcagaucgccaucugcggcaugucaaccugguccaaaaggucccucagccaggaagacgccccccagacccccaggcccguggccgaaaucgugcccagcuuuaucaacaaggacaccgagaccaucaacaugaugagcgaguuuguggccaaccucccccaggagcugaagcugacccugagcgagaugcagcccgcgcugccccaacugcagcagcacgugccggugcugaaggacucgagccugcuguucgaggaguucaagaagcucaucaggaacaggcagagcgaggccgccgauucgagccccagcgagcucaaguaccuggggcuggacacucacagccggaagaagcggcagcuguacagcgcccuggcgaacaaguguugccacgugggcugcaccaagaggagccuggccagguucugu

SEQ ID NO: 348 - RNA, 555 nt, Artificial Sequence
  Synthetic Polynucleotide
augcccaggcuguucuuuuuccaccuccugggggugugucugcuccugaaccaguucagcagggccguggccgauuccuggauggaggaggucaucaagcuguguggaagggagcuggugagggcccagaucgccaucugcgggauguccaccuggagcaagcggagccugucccaggaggacgccccgcagacccccaggccgguggcggagaucguccccagcuucaucaacaaggacaccgagaccaucaacaugaugagcgaguucguggccaaccugccccaggaacugaagcucacccugagugagaugcagcccgcccugccccagcugcagcagcaugugcccgugcugaaggacagcagccugcucuucgaggaguucaagaagcugaucaggaacaggcagagcgaggccgccgacagcucccccuccgagcugaaguaccuuggacuggacacccacagccggaagaagcggcaacuguacuccgcccuggccaacaagugcugccacgugggcuguacgaagaggagccuggccagguucugc

SEQ ID NO: 349 - RNA, 555 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcggccgggagcuggugcgggcccagaucgccaucugcggcaugagcaccuggagcaagcggagccugagccaggaggacgccccccagaccccccggcccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugauccggaaccggcagagcgaggccgccgacagcagccccagcgagcugaaguaccugggccuggacacccacagccggaagaagcggcagcuguacagcgcccuggccaacaagugcugccacgugggcugcaccaagcggagccuggcccgguucugc

SEQ ID NO: 350 - RNA, 555 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcgggagggagcuggugagggcgcagaucgcgaucugcgggaugagcacguggagcaagaggagccugagccaggaggacgcgccgcagacgccgaggccgguggcggagaucgugccgagcuucaucaacaaggacacggagacgaucaacaugaugagcgaguucguggcgaaccugccgcaggagcugaagcugacgcugagcgagaugcagccggcgcugccgcagcugcagcagcacgugccggugcugaaggacagcagccugcuguucgaggaguucaagaagcugaucaggaacaggcagagcgaggcggcggacagcagcccgagcgagcugaaguaccuggggcuggacacgcacagcaggaagaagaggcagcuguacagcgcgcuggcgaacaagugcugccacguggggugcacgaagaggagccuggcgagguucugc

SEQ ID NO: 351 - RNA, 555 nt, Artificial Sequence
  Synthetic Polynucleotide
augccccggcuguucuucuuccaccugcugggcgugugccugcugcugaaccaguucagccgggccguggccgacagcuggauggaggaggucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugc

SEQ ID NO: 352 - RNA, 276 nt, Artificial Sequence
  Synthetic Polynucleotide
augccccggcuguucuuuuuccaccugcugggcgugugccugcugcugaaccaguuuucuagggccguggccgacagcuggauggaggaagugaucaagcugugcggccgggagcuggugagagcacagaucgccaucuguggcauguccaccuggagcggcuccaacggcucuaccaacgauucuaauggcagcacaggcucccagcuguacagcgcccuggccaauaagugcugucacgugggcugcacaaagaggucccuggcccgcuucugu

SEQ ID NO: 353 - RNA, 276 nt, Artificial Sequence
  Synthetic Polynucleotide
augccccggcuguucuuuuuccaccugcugggcgugugccugcugcugaaccaguuuucuagggccguggccgacagcuggauggaggaagugaucaagcugugcggccgggagcuggugagagcacagaucgccaucuguggcauguccaccuggagcggcuccaacggcucuaccaacaccucuaauggcgacacaggcucccagcuguacagcgcccuggccaauaagugcugucacgugggcugcacaaagaggucccuggcccgcuucugu

SEQ ID NO: 354 - RNA, 276 nt, Artificial Sequence
  Synthetic Polynucleotide
augccccggcuguucuuuuuccaccugcugggcgugugccugcugcugaaccaguuuucuagggccguggccgacagcuggauggaggaagugaucaagcugugcggccgggagcuggugagagcacagaucgccaucuguggcauguccaccuggagcggcuccaacggcaagaccaacaccucuaauggcgacacaggcucccagcuguacagcgcccuggccaauaagugcugucacgugggcugcacaaagaggucccuggcccgcuucugu

SEQ ID NO: 355 - RNA, 291 nt, Artificial Sequence
  Synthetic Polynucleotide
augccccggcuguucuuuuuccaccugcugggcgugugccugcugcugaaccaguuuuccagggccguggccgacucuuggauggaggaagugaucaagcugugcggccgggagcuggugagagcacagaucgccaucuguggcaugucuaccuggucuggcagcacaaacuccggcucuaccagcuccggcaacagcggcuccggcaauucuggcagccagcuguacagcgcccuggccaauaagugcugucacgugggcugcacaaagaggucccuggcccgcuucugu

SEQ ID NO: 356 - RNA, 291 nt, Artificial Sequence
  Synthetic Polynucleotide
augccccggcuguucuuuuuccaccugcugggcgugugccugcugcugaaccaguuuuccagggccguggccgacucuuggauggaggaagugaucaagcugugcggccgggagcuggugagagcacagaucgccaucuguggcaugagcaccuggucuggcagcacaaacuccggcucugauaccagcuccggcaacagcggcuccggcaauucuggccagcuguacagcgcccuggccaauaagugcugucacgugggcugcacaaagaggucccuggcccgcuucugu

SEQ ID NO: 357 - RNA, 291 nt, Artificial Sequence
  Synthetic Polynucleotide
augccccggcuguucuuuuuccaccugcugggcgugugccugcugcugaaccaguuuucuagggccguggccgacagcuggauggaggaagugaucaagcugugcggccgggagcuggugagagcacagaucgccaucuguggcauguccaccuggagcggcuccacaaacucuggcagcgauaccggcucuggcaacuccaagucuggcaauagcggccagcuguacuccgcccuggccaauaagugcugucacgugggcugcacaaagaggagccuggcccgcuucugu

SEQ ID NO: 358 - RNA, 291 nt, Artificial Sequence
  Synthetic Polynucleotide
augccccggcuguucuuuuuccaccugcugggcgugugccugcugcugaaccaguuuucuagggccguggccgacagcuggauggaggaagugaucaagcugugcggccgggagcuggugagagcacagaucgccaucuguggcauguccaccuggagcggcuccacaaacucuggcagcgacaccuccggcaagaacucuggcgauggcaauagcggccagcuguacuccgcccuggccaauaagugcugucacgugggaugcacaaagcggagccuggcccgcuucugu

SEQ ID NO: 359 - RNA, 291 nt, Artificial Sequence
  Synthetic Polynucleotide
augccccggcuguucuuuuuccaccugcugggcgugugccugcugcugaaccaguuuagcagggccguggcagacuccuggauggaggaagugaucaagcugugcggccgggagcuggugagagcacagaucgccaucuguggcaugucuaccuggucuggcagcacagacuccggcucugauaccagcuccggcaacagcggcgauggcaauuccggccagcuguacucugcccuggccaauaagugcugucacgugggcugcacaaagaggagccuggcccgcuucugu

SEQ ID NO: 360 - RNA, 321 nt, Artificial Sequence
  Synthetic Polynucleotide
augccccggcuguucuuuuuccaccugcugggcgugugccugcugcugaaccaguuuuccagggccguggccgacucuuggauggaggaagugaucaagcugugcggccgggagcuggugagagcacagaucgccaucuguggcaugucuaccuggagcggcagcuccggcucuacaaacgauuccaauggcucuaccggcacaggcagcgacggcuccaccaacggcucugauggcagcacaggaggacagcuguacagcgcccuggccaauaagugcugucacgugggaugcaccaagaggucccuggcccgcuucugu

SEQ ID NO: 361 - RNA, 381 nt, Artificial Sequence
  Synthetic Polynucleotide
augccccggcuguucuuuuuccaccugcugggcgugugccugcugcugaaccaguuuagcagggccguggcagacuccuggauggaggaagugaucaagcugugcggccgggagcuggugagagcacagaucgccaucuguggcaugagcaccugguccggcucuacaaacagcggcuccgacaccagcuccggcuccacaaauucuggcagcgauaccucuagcggcaacuccggcucuggcaauagcggcuccaagggcaccggcucugauggcagcacaaacggcuccaauggcucuaccggaggacagcuguacucugcccuggccaauaagugcugucacgugggcugcacaaagaggucccuggcccgcuucugu

SEQ ID NO: 362 - RNA, 1341 nt, Artificial Sequence
  Synthetic Polynucleotide
augcccaggcuguucuuuuuccaccugcugggcgugugccugcugcugaaccaguuuucccgcgccguggcagacucuuggauggaggaagugaucaagcugugcggccgggagcuggugagagcacagaucgccaucuguggcaugucuaccuggagcaagcggucccugucucaggaggacgccccucagacaccuagaccaguggccgagaucgugcccagcuucaucaacaaggauaccgagacaaucaauaugauguccgaguucguggccaaucugccucaggagcugaagcugacccuguccgagaugcagccagcccugccacagcugcagcagcacgugccagugcugaaggauagcucccugcuguuugaggaguucaagaagcugauccggaacagacaguccgaggccgccgacucuagcccuucugagcugaaguaccugggccuggauacccacagcaggaagaagcgccagcuguauuccgcccuggccaauaagugcugucacgugggcugcacaaagaggucccuggcccgcuuuuguggcggcggcggcucuggaggaggaggcagcggcggaggaggcagcauggugcgguccguggagugcccaccuuguccagcaccaccaguggcaggcccuagcguguuucuguucccuccaaagccaaaggacacccugaugaucucuaggacccccgaggugacaugcguggugguggacgugagccacgaggaccccgaggugcaguucaacugguacguggauggcauggaggugcacaaugccaagacaaagccccgggaggagcaguuuaacagcaccuucagagugguguccgugcugacaguggugcaccaggacuggcugaacggcaaggaguauaagugcgccguguccaauaagggccugccagcaccuaucgagaagaccaucucuaagacaaagggccagccuagggagccacagguguacacccugcccccuucccgcgaggagaugaccaagaaccaggugucucugacaugucuggugaagggcuuuuaucccucugacaucgccguggagugggagagcaauggccagccugagaacaauuacaagaccacaccacccaugcuggacuccgauggcagcuucuuccuguauucuaagcugacaguggauaagagccgguggcagcagggcaacguguucagcuguuccgugaugcacgaggcccugcacaaucacuacacccagaagucucugagccugucccccggcaagggcaagccaauccccaauccucugcugggccuggauagcacacaccaccaccaccaccac

SEQ ID NO: 363 - RNA, 984 nt, Artificial Sequence
  Synthetic Polynucleotide
augccuaggcuguucuuuuuccaccugcugggcgugugccugcugcugaaccaguuuucucgcgccguggcagacagcuggauggaggaagugaucaagcugugcggccgggagcuggugcgcgcacagaucgccaucuguggcaugagcaccugguccaagcggagccugagccaggaggacgcaccacagacacccagaccuguggccgagaucgugccuuccuuuaucaacaaggauaccgagacaaucaauaugaugucugaguucguggccaaucugccccaggagcugaagcugacccuguccgagaugcagccagcccugccacagcugcagcagcacgugccugugcugaaggauagcucccugcuguuugaggaguucaagaagcugauccggaacagacaguccgaggccgccgacucuagcccaucugagcugaaguaccugggccuggauacccacagcaggaagaagcgccagcuguauuccgcccuggccaauaagugcugucacgugggcugcacaaagcggucccuggccagauuuuguggcggcggcggcucuggaggaggaggcagcggcggaggaggcuccgacauccagaugacccagagcccuuccucucuguccgccucugugggcgaucgggugaccaucacaugcagggccagccggcccaucggcacaaugcugagcugguaucagcagaagccuggcaaggccccaaagcugcugauccuggccuucucuaggcugcagagcggcgugcccucccgcuuuagcggcuccggcucuggcaccgacuucacccugacaaucagcucccugcagccagaggauuuugccaccuacuauugugcccaggccggcacacaccccaccacauucggccagggcaccaagguggagaucaagaggggcaagccaauccccaacccucugcugggccuggacagcacacaccaccaccaccaccac

SEQ ID NO: 364 - RNA, 291 nt, Artificial Sequence
  Synthetic Polynucleotide
augccucgacuguucuuuuuccaccugcugggcgugugccugcugcugaaucaguuuagccgggccgucgccgauaguuggauggaggaagugaucaagcugugcggccgggagcuggugagagcacagaucgccaucuguggcauguccaccuggucuggcagcuccggaggaggcucuggcucuagcuccggcucuagcggcagcggcggcuccggccagcuguacagcgcucuggcuaauaaguguugucacgucggauguacuaaacgaagucuggcuagauuuugc

SEQ ID NO: 365 - RNA, 555 nt, Artificial Sequence; identical to SEQ ID NO: 328
  Synthetic Polynucleotide

SEQ ID NO: 366 - RNA, 534 nt, Artificial Sequence
  Synthetic Polynucleotide
augggcgugaaagugcuguuugcgcugauuugcauugcgguggcggaagcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 367 - RNA, 1236 nt, Artificial Sequence
  Synthetic Polynucleotide
augggcgugaaagugcuguuugcgcugauuugcauugcgguggcggaagcggacucauggauggaggaaguuauuaaauuaugcggccgcgaauuaguucgcgcgcagauugccauuugcggcauggagcccaagagcagcgacaagacccacaccagcccccccagccccgcccccgagcugcugggcggcagcagcguguuccuguucccccccaagcccaaggacacccucuacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagacaaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaagagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 368 - RNA, 498 nt, Artificial Sequence
  Synthetic Polynucleotide
augggcgugaaagugcuguuugcgcugauuugcauugcgguggcggaagcggacucauggauggaagagguuauuaaauuauguggccgugaauuggugcgugcacaaauagcuauuugcggcaugggcgguggcggcucugguggcggcggcucuggagggggcggaagugguggaggagguaguggcggagguggaucgggaggcggaggaucuggaggggggggcuccuuucaaagcuccucgagcaaagcgcccccucccagccugcccagcccuaguaggcugcccgguccgagcgacacgcccauccugccccaggguggcgguggcucuggggguggcgguucaggcggaggugguucuggcggaggcggaucagguggugggggauccggcggcggcggaucugguggcggggggagucagcucuacucugcguuggccaauaaaugcugccauguugguuguacaaaaagaucuuuggcuagauuuugc

SEQ ID NO: 369 - RNA, 1236 nt, Artificial Sequence
  Synthetic Polynucleotide
augggcgugaaggugcuguucgcacugaucugcaucgccguggccgaggccgacagcuggauggaggaggugaucaagcugugcggcagagagcuggugagagcccagaucgccaucugcggcaugagcaccuggagcgagcccaagagcagcgacaagacccacaccagcccccccagccccgcucccgagcugcugggcggcagcagcguguuccuguucccccccaagcccaaggacacccuguacauaaccagagagccagaggugaccugcguggugguggacgugagccacgaggaccccgaggugaaguucaacugguacguggacggcguggaggugcacaacgccaagacaaagcccagagaggagcaguacaacagcaccuacagaguggugagcgugcugaccgugcugcaccaggacuggcugaacggcaaggaguauaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggccuuacacaaccacuacacccagaagagccuaagccugagccccggcaagagaaagaagagaagucugagccaggaggacgccccccagacccccagacccguggccgagaucgugcccuccuucauuaacaaggacaccgagaccaucaacaugaugagcgaguucguggccaaccugccccaggagcugaagcugacccugagcgaaaugcaacccgcccugccccagcugcaacagcacgugcccgugcugaaggacagcagccugcuguucgaggaguucaaaaagcugaucagaaacagacagagcgaggccgccgacuccagccccagcgagcugaaguaccugggccuggacacccacagcagaaagaagagacagcuguacagcgcccuggccaacaagugcugccacgugggcugcaccaagagaagccuggccagauucugc

SEQ ID NO: 370 - RNA, 510 nt, Artificial Sequence
  Synthetic Polynucleotide
augggaguuaaagugcuuuuugcgcuuauuuguauugcggucgcggaggcugacucauggauggaagaggucauuaagcucuguggaagggaacucguuagagcccaaauagcuauuugcgggaugaguacaugguccggugggggugguucggguggaggugggucgggaggaggaggcuccgguggaggcggcagugggggcggaggguccggugggggugggucuggaggaggugguucguuucagucuucaucuuccaaagcuccuccuccuucgcuucccagcccuagcaggcuuccagguccaucagauacuccaauauugccccagggaggggguggaucaggaggaggagggaguggugggggaggaucugguggaggugguuccggaggaggaggaagcggggggggagguucaggcggugguggaagccaacuguauagugcguuggcuaacaaauguugucaugucggauguacuaaaaggagccucgccagguuuugc

SEQ ID NO: 371 - RNA, 534 nt, Artificial Sequence; identical to SEQ ID NO: 366
  Synthetic Polynucleotide

SEQ ID NO: 372 - RNA, 558 nt, Artificial Sequence
  Synthetic Polynucleotide
augagcagcagacugcugcugcagcugcugggcuucuggcuguuccugagccagcccugcagagccagagugagcgaggaguggauggaccaggugauccaggugugcggcagaggcuacgccagagccuggaucgaggugugcggccccagcgugggcagacuggcccugagccaggaggagcccgccccccuggccagacaggccaccgccgagguggugcccagcuucaucaacaaggacgccgagcccuucgacaugacccugaagugccugcccaaccugagcgaggagagaaaggccgcccugagcgagggcagagcccccuuccccgagcugcagcagcacgcccccgcccugagcgacagcguggugagacuggagggcuucaagaagaccuuccacaaccagcugggcgaggccgaggacggcggcccccccgagcugaaguaccugggcagcgacgcccagagcagaaagaagagacagagcggcgcccugcugagcgagcagugcugccacaucggcugcaccagaagaagcaucgccaagcugugc

SEQ ID NO: 373 - RNA, 1236 nt, Artificial Sequence
  Synthetic Polynucleotide
augggggugaaggugcuguucgcccucaucugcauagcgguggccgaggccgacucuuggauggaggaggugaucaagcucugcggcagggagcucgugcgugcccagaucgcgaucugcggcaugagcaccuggucagagccaaagagcagcgauaagacgcauaccagcccucccagccccgcccccgagcugcugggcgggagcagcguguuccucuucccacccaagccaaaggacacccucuacaucacccgcgagcccgaggugacgugcguugugguggacgugucccacgaggaccccgaggucaaguucaacugguacguggacggcguggaaguccacaacgccaagaccaagccucgggaggagcaguacaacagcaccuacaggguggugagcguccugacaguccugcaccaggacuggcugaauggcaaggaauacaagugcaaggugucaaacaaggcccugcccgcccccaucgagaaaaccaucagcaaggccaagggccagccacgugagccccagguguacacccugccccccagcagggacgagcucaccaagaaccaggugagccugaccugccuggugaaagguuucuacccuucugacaucgcgguugagugggagagcaauggccaacccgagaacaacuacaagacaaccccgcccgugcuggacuccgaugggagcuucuuccuguauagcaagcugaccguggacaagagccgcuggcagcagggcaacguguucagcugcuccgucaugcacgaggcccugcauaaccacuacacccaaaagagccugucccugagccccggcaagcgcaagaagaggucccugagccaagaagacgccccgcagacgcccaggcccguggccgagaucgugcccagcuucaucaacaaggauaccgagacaaucaacaugaugucggaauuuguggcuaaccugccccaagagcugaaacugacccugucggaaaugcagcccgcgcugccgcagcugcagcagcacgugccggugcugaaggauagcagcuugcuguucgaggaauucaagaagcucauccguaaucgacagagcgaggcggccgauuccagccccagcgagcugaaguaucuggggcuggauacccacagccgcaagaagcggcagcuguacucugcucuggccaauaaguguugccacgucggcugcaccaaacgcagccuggccagguucugc

SEQ ID NO: 374 - RNA, 1236 nt, Artificial Sequence
  Synthetic Polynucleotide
augggcgucaagguccucuucgcccuuaucugcaucgccguggccgaggccgacagcuggauggaggaggugaucaagcuuugcggccgggagcuugugcgcgcgcagaucgccauuugcggcaugagcaccugguccgaaccaaagagcuccgacaagacccacaccuccccuccuucccccgcccccgagcugcugggcggcagcagcgucuuccuguucccgcccaagcccaaggacacccuguacaucaccagggagcccgaggugacaugugucgugguggacgugucacacgaggaccccgaggugaaguucaacugguacgucgacggcguggaggugcacaacgcaaaaaccaagccccgggaggaacaguacaacagcaccuaccggguggucagcgugcugaccgugcuccaucaggacuggcugaacggcaaggaguacaaaugcaaggucagcaacaaagcccugcccgccccaaucgaaaagaccaucuccaaggccaaggggcagcccagggaaccccagguguacacccugccccccagcagggacgagcucaccaagaaccaggugagccugaccugccuggugaagggguucuaccccagcgacaucgccguggagugggaaagcaacggccaacccgaaaacaacuacaagaccaccccgccggugcuggacucugacggcagcuucuuccucuacagcaagcugaccguugacaaauccagguggcaacagggcaacgucuucagcugcagcgugaugcaugaagcgcugcacaaccauuacacgcagaaaagccugucccugagccccggcaagaggaagaaaaggagccugucccaggaggacgccccucagaccccgcgacccguggccgagaucgugccuagcuucauuaacaaggacaccgagacgaucaacaugaugagcgaguucguggccaaucugccccaggagcugaagcucacccucagcgagaugcagcccgcccugccccagcugcagcagcacgucccgguccugaaggacagcagccugcuguucgaggaguucaagaagcugaucaggaacaggcagagcgaggccgccgacuccucccccuccgagcugaaguaccucggccuggacacccacuccaggaagaagcggcagcuguacucagcccuggccaacaagugcugccacgugggcugcaccaagcggagccuggcccgguucugc

SEQ ID NO: 375 - RNA, 1236 nt, Artificial Sequence
  Synthetic Polynucleotide
augggcgugaaggugcuguucgcccucaucugcaucgccguggccgaggccgacagcuggauggaggaggugaucaaacucugcggcagggagcucgugcgcgcccagaucgccaucugcgggauguccaccuggagcgagcccaagagcuccgacaaaacccacaccagcccgcccagcccagcccccgagcugcugggcggcagcagcguguuccucuucccucccaagcccaaggacacgcuguacaucacccgggagcccgaggugaccugcguggugguggacgugagccacgaggacccugaagugaaguuuaacugguauguugacggcguggaggugcacaacgcaaagaccaagccccgcgaggagcaguacaacagcaccuaccgcgucgucagcgugcugacaguccuccaccaggauuggcugaacggcaaggaguacaagugcaagguguccaacaaggcccugcccgccccgaucgagaagaccauuagcaaggccaagggccagccaagggagccacaaguguacacccugccaccuuccagggacgagcugaccaagaaucaggucagccugaccugccugguuaagggcuucuacccaagcgacaucgccguugagugggagagcaacggacagccugagaacaacuauaagacuaccccucccgugcuggauuccgacggaagcuucuuccuguacagcaagcugaccguggacaagagcagauggcagcaggguaacguguuuuccugcuccgugaugcaugaggcccugcacaaccacuacacccagaaaagccucagccugagccccggcaaacgcaagaagcggagccugucgcaagaggacgccccccagacccccaggccuguggccgagaucguccccagcuucaucaacaaggacaccgagacuaucaacaugaugagcgaauucguggccaaccucccccaggaacugaagcugacccugagcgagaugcagcccgcccugccccagcugcagcagcacgugcccguacugaaggacagcucccugcuguuugaagaguuuaagaagcugauccggaacaggcaguccgaagccgccgacagcucccccagcgagcugaaauaccuggggcuggacacccacagccggaaaaagcgccagcucuacagcgcccuggccaacaagugcugccacgugggcugcaccaagcguucccuggcccgguuuugc

SEQ ID NO: 376 - RNA, 1236 nt, Artificial Sequence
  Synthetic Polynucleotide
augggcgugaagguccucuucgcccucaucugcaucgccguggccgaggccgacuccuggauggaggaggugauaaagcucugcggcagggagcucgugcgcgcccaaaucgccaucugcgggaugagcaccuggagcgagcccaagagcuccgacaagacacacaccuccccgcccagccccgccccagagcugcugggcgggagcagcgucuuucuguucccgcccaagcccaaggacacccuguacaucacgcgcgagcccgaagugaccugcguggucguggacgugagccacgaggacccugaggugaaguucaacugguacguggacggcguggaggugcacaacgcuaagaccaagccccgggaggagcaguacaacucaaccuacagaguggugagcguccucacggugcugcaccaggauuggcugaauggcaaggaguauaaaugcaaggugagcaacaaagcacugcccgcccccaucgagaagacaaucucuaaggccaagggccagcccagggagccccagguguacacccugccccccucaagagacgagcugaccaagaaucaggugucccugaccugccucgugaagggcuucuaccccagcgauaucgcuguggagugggaguccaacgggcagccggagaacaacuacaagaccaccccacccgugcuggacagcgacgggagcuuuuuccuguacagcaagcugaccgucgacaagagcagauggcagcagggcaacguguucagcugcagcgucaugcacgaggcccugcacaaccacuacacacaaaagagccugagccugucgccaggcaagcgaaagaagagaagcuugagccaggaggacgccccccagaccccccggcccguggccgagaucgugcccagcuucaucaacaaggacaccgagacuauuaacaugaugagcgaguucguggccaaucugccccaggagcucaaacuuacccuguccgagaugcagcccgcccugccccagcugcagcagcacgugcccgugcugaaggacaguucccugcuguucgaggaguucaaaaagcugauccgcaacagacagagcgaggccgccgauagcagccccuccgagcugaaguaccucggccuggacacccacagcaggaagaagaggcagcuguacagcgcccuggccaauaagugcugucacguuggcugcaccaagcgcagccucgcccgguuuugc

SEQ ID NO: 377 - RNA, 1236 nt, Artificial Sequence
  Synthetic Polynucleotide
augggcgugaaggugcuguucgcccucaucugcauugccguggccgaagccgacagcuggauggaagaggucaucaagcucugcggcagggagcucgugagggcccagaucgccaucugcggcaugagcaccuggagcgagcccaaguccagcgacaagacccacaccagcccgcccagccccgccccggagcuucuugggggcagcagcguguuccuguucccacccaagcccaaggacacccuguacaucacccgggaacccgaggugaccugcguggucguugacgucagucacgaggaucccgaagucaaguuuaacugguauguggacggcguggagguccacaaugccaaaaccaagccacgggaggaacaguauaauuccaccuacaggguggucagcgugcucaccgugcuccaccaggacuggcucaacggaaaggaguauaagugcaaggugagcaauaaggcccugccugcccccaucgagaagaccaucuccaaggcgaaaggccagccccgggagccucaggucuacacccugccccccagccgcgacgagcucaccaagaaccaggugagccucaccugccuggugaagggcuucuaccccagcgacaucgccguggagugggaguccaacggacagcccgagaacaacuacaagaccaccccaccgguccuggacagcgauggcuccuucuuccuguacagcaaacugaccguggacaagagccgguggcagcagggcaacguguucagcugcagcgucaugcacgaggcgcugcacaaucacuacacccagaaaucccugagccugucccccggcaagaggaagaagaggagccugagccaggaggacgccccccagacacccaggcccguggccgagaucgugcccuccuucaucaacaaggauaccgaaaccaucaacaugaugagcgaguucguagccaaccugccgcaggagcucaagcugacccugagcgagaugcagcccgcccugccccagcugcaacagcacgugcccgugcucaaggacagcagccugcuguucgaggaguucaaaaagcugauccguaaccgccagagcgaggccgccgauucuagccccuccgagcugaaguaucugggacuggacacccacucccgcaagaaacggcagcuuuauuccgcccuggccaacaagugcugccacgugggcugcaccaaaaggucccuggccagguuuugc

SEQ ID NO: 378 - RNA, 1236 nt, Artificial Sequence
  Synthetic Polynucleotide
augggcgugaaagugcucuuugcccucaucugcaucgccguggccgaggccgacagcuggauggaggaggugauaaagcucugcgggcgggagcucguccgggcccagaucgccaucugcgguaugagcaccuggagcgagcccaaguccagcgacaagacccacaccucgccccccagcccggcccccgagcugcuggggggaagcagcguguuccuguucccgcccaagcccaaggacacccuguacaucacacgagagcccgaaguuaccugcgucgugguggacgugagccacgaggaccccgaggugaaguucaauugguacguggacggaguggaggugcacaaugcaaaaaccaagccccgagaggagcaguacaauagcaccuacaggguggugagcgugcugacugugcugcaccaggacuggcugaacgggaaggaguacaagugcaagguuagcaacaaggcccuccccgccccaaucgagaagaccaucuccaaggcuaagggccagcccagggagccccaggucuauacacucccgcccagcagagaugagcucaccaagaaccaggucagccugaccugucuggugaaaggcuucuaccccagcgacauugccguggagugggaguccaacggccagcccgagaacaacuacaagaccacuccccccguacuggauuccgacggcagcuucuuccuguacagcaagcucaccguggacaaauccagguggcagcagggcaacguguuuuccugcagcguaaugcaugaggcccuccacaaccacuacacccagaaaagccugagccugagccccgggaagaggaagaagaggagccugucccaggaggacgccccccagacccccaggcccguggccgagaucguccccagcuucaucaauaaggacacggagacgaucaacaugaugagcgaauucguggcaaaccucccccaggagcugaaacugacgcugagcgagaugcagccagcccugccucagcugcagcaacaugugcccgugcugaaggacagcuccuugcuguucgaggaauucaagaagcugauccggaacaggcagagcgaggccgccgacuccagccccuccgagcugaaguaccugggccuggacacccacucccgaaaaaagcgucagcuguacagcgcccuggcgaacaaaugcugccaugucggcuguaccaagcggucccuggcccgcuucugc

SEQ ID NO: 379 - RNA, 1236 nt, Artificial Sequence
  Synthetic Polynucleotide
augggggugaagguccucuucgcguugaucugcaucgccguggccgaggcagauagcuggauggaggagguuaucaagcucuguggucgcgagcucgugcgcgcccaaaucgccaucugcggcaugagcaccuggagcgagccgaaaagcagcgacaagacacacaccuccccuccgagccccgcucccgagcuucuggguggguccucaguguuucuguucccgcccaagccaaaggacacgcuguacaucaccagagagcccgaagugacuugcgugguggucgacgugucccacgaggacccugaagucaaguucaacugguacguggacggcguggaggugcacaacgccaagacaaagccccgggaggaacaguacaacuccaccuaccgggugguguccgugcucaccgugcuccaccaggacuggcugaacggcaaggaguacaagugcaaggugagcaacaaggcucugcccgcccccaucgagaagacgaucuccaaggccaaggggcaacccagggaaccgcaggucuauacccugccccccucucgggacgagcugacgaagaaccagguuagccucaccugccuggugaagggcuucuaccccuccgacaucgccgucgagugggaauccaacgggcagccugagaacaauuacaagaccaccccucccguccuggacuccgacggcagcuucuuucucuacuccaagcucaccguggacaagucgagguggcagcagggaaacguguucuccuguagcgugaugcacgaggcccugcacaaccacuacacccagaaaagccugagccucagccccgggaagcggaaaaagcgcucccugucccaggaggacgccccccagacaccccggcccguggccgagaucgucccuuccuucaucaauaaagacaccgagacaaucaacaugaugagcgaguucguggccaaccugccccaggaacugaagcugacccucucggagaugcagcccgcgcugccgcagcugcagcagcaugugcccgugcugaaagacagcagccugcuguucgaggaguuuaagaagcucaucagaaauagacagagcgaggccgccgauagcuccccaagcgagcucaaguaccucgggcuggacacgcacagcagaaagaagagacagcuguacagcgcccuggccaauaagugcugccacgucggcugcaccaagcggagcuuggcgagguucugc

SEQ ID NO: 380 - RNA, 1236 nt, Artificial Sequence
  Synthetic Polynucleotide
augggcguaaaggugcucuuugcccuaaucugcaucgccguggccgaggccgacucguggauggaggaggugaucaagcucugcggccgggagcucgugcgcgcccagaucgccaucugcgggaugagcaccuggagcgagcccaaaaguuccgacaagacccacaccagcccgcccagccccgcccccgagcugcugggagggagcagcguguuccuguucccacccaagcccaaggacacccuguacaucacccgcgagcccgaggugaccugcguggugguggacgugucccaugaggauccggaggugaaguucaacugguacguggacggcguggaggugcacaacgccaaaaccaagcccagggaggagcaguacaauuccaccuacaggguggugagcguccugacgguccugcaccaagacuggcugaauggcaaggaguacaagugcaaggugagcaacaaggcccugcccgcgccuaucgagaagacgaucagcaaggccaaaggccaaccgagggagccccagguguauacccugccccccagcagggacgagcucaccaagaaucaagugucacugaccugccuggugaagggcuucuaccccuccgacaucgcuguggagugggagagcaacggccagcccgaaaauaacuacaagaccaccccgcccgugcuggacagcgacggcaguuucuuucuguacagcaagcugaccguggacaaguccagauggcagcagggcaacguguucagcuguagcgucaugcacgaggcccugcauaaucacuacacccagaaaagccugucccugagcccagggaagcggaagaagcgaucccucagccaggaggacgccccgcagacccccagacccguugccgagaucgugcccucauucaucaacaaggacacagagacaaucaacaugauguccgaauucguggccaaccucccccaggagcucaagcugacccucagcgagaugcagcccgcccugccccagcugcagcagcaugugcccgugcugaaggacucgagccugcuguucgaagaguucaagaagcugaucagaaaucgucaguccgaggccgccgacagcagccccagcgaacucaaguaccugggccuggacacccacagccgcaagaagaggcagcuguacagcgcccuggccaacaagugcugccacguggguugcaccaagcgcagcuuggccagguuuugc

SEQ ID NO: 381 - RNA, 1236 nt, Artificial Sequence
  Synthetic Polynucleotide
augggcgugaaggugcuguucgcccucauuuguaucgccguggccgaagcggacagcuggauggaggaggugaucaaacuaugcggcagggagcucgugagagcucagauugccaucugcggcaugucgaccuggagcgagcccaagagcagcgacaagacccacaccuccccgcccagccccgcccccgagcugcuggggggcagcagcguguuccuguuuccccccaagcccaaggacacccuguacaucacccgagagcccgaggugaccuguguggugguggacguuucccacgaggaccccgaggucaaguucaacugguacguggauggcguggaggugcacaaugccaagacuaagccccgagaggagcaguacaacagcaccuacaggguggucagcgugcugaccguccugcaccaggacuggcugaacgggaaggaauacaagugcaagguaagcaacaaggcccugccugcccccaucgagaagaccauuuccaaggccaagggccaaccaagggagccccagguguacacccugccccccagcagagacgaacugaccaagaaccaggugagccugaccugccuggucaagggguucuaccccuccgacaucgccguggagugggaguccaacggccagcccgagaacaacuacaagaccaccccgcccguccucgauagcgacgggagcuucuuccuguacucaaagcugacaguggacaagagcagguggcagcagggcaacguguucuccugcagcgugaugcacgaagcccugcauaaccacuauacccagaagucccugagccugagccccggaaagcgcaaaaagcgcagccugagccaggaggacgccccacaaacccccaggcccguggccgagaucgugcccagcuucaucaacaaggacacugagacgaucaacaugauguccgaguuuguggccaaccugccccaggagcugaagcugacccugucugagaugcagcccgcccugccucagcuccagcagcacgugcccguccucaaggacagcagccugcuguucgaggaguuuaagaagcugauccggaacaggcagucagaggccgccgacagcagccccagcgagcugaaguaccucggccuggacacacauagccggaagaagaggcagcucuacagcgcccucgccaacaaaugcugccacgugggcugcaccaagaggagccuggccagauucugu

SEQ ID NO: 382 - RNA, 1236 nt, Artificial Sequence
  Synthetic Polynucleotide
augggcgugaagguccucuucgcccucaucugcaucgccguggccgaggccgauagcuggauggaggaggucaucaagcucugcgggcgagagcucgugagagcccagaucgccaucugcggcaugagcaccuggagcgagcccaaguccucggacaagacgcauaccagcccgcccagccccgcccccgagcugcuggggggcagcagcguguuccuguucccacccaagcccaaggacacccuguauaucacccgggaaccugaggugacaugcguggugguggacguaagccacgaggacccagaggugaaguuuaacugguacguggacgggguggaggugcacaaugccaagaccaagccuagggaggagcaauacaacuccaccuaccgcguggugagcgugcugacgguccugcaccaggacuggcugaacggcaaagaguacaagugcaaaguguccaacaaagcccugcccgcccccaucgagaagaccaucuccaaggccaaggggcagcccagagagccccagguguacacccugccccccucuagggacgagcucaccaagaaccaggugagccugaccugccuggugaagggcuucuacccguccgacaucgccguggagugggagagcaacggccaacccgagaacaacuacaagaccaccccgccggugcucgacuccgacggcagcuucuuccucuacagcaagcuaaccguggauaagagccgcuggcagcagggcaacgucuucagcugcagcgucaugcacgaggcccugcacaaccacuacacccagaaaagccugucccugucccccggcaagcggaagaagagaucgcugucccaggaggacgccccccaaacgcccaggcccguagccgagaucgugcccagcuucaucaacaaggacaccgagacaauuaacaugaugagugaguuuguggccaaucucccccaggagcugaagcucacccugagcgagaugcagcccgcccucccccagcugcagcagcacgugcccgugcugaaggacagcucccuccuguucgaagaguucaagaagcugaucaggaaccggcagagcgaggccgccgacuccagccccagcgagcugaaguaccugggucuggauacccacuccaggaagaagcggcagcuguacagcgcccuggccaacaaguguugucacgucgguugcacgaaacggucgcucgcccgguuuugu

SEQ ID NO: 383 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccagccccccaagccccgcucccgagcugcugggcggcagcagcguguuccuguucccuccuaaaccuaaggacacccuguacaucacccgggagcccgaggugaccugcguggugguggacgugagccacgaggacccugaggugaaguucaacugguacguggacggcguggaggugcacaacgccaagaccaagccacgggaggagcaguacaacagcaccuaccggguggugagcgugcugaccgugcugcaccaggacuggcugaacggcaaggaguacaagugcaaggugagcaacaaggcccugccugcgcccaucgagaagaccaucagcaaggccaaggggcagccuagagaaccccagguguacacccugccucccagccgggacgagcugaccaagaaccaggugagccugaccugccuggugaagggcuucuaccccagcgauauugcuguggagugggagagcaacggccagccugagaacaacuacaagaccaccccucccgugcuggacagcgacggcagcuucuuccuguacagcaaacugacaguggacaagagccgguggcagcagggcaacguguucagcugcagcgugaugcacgaagcccugcacaaccacuacacccagaaaagccuaagccugucacccggcaagcggaagaagcgguccuugagccaggaggacgcgccucagaccccccggccuguggcugaaaucgugcccagcuucaucaacaaagacaccgagacgauaaacaugaugagcgaguucguggccaaccugccccaggagcugaagcucaccuugagcgagaugcagcccgcucugccacaacuccagcagcacgugcccguccuuaaggacagcagccugcuuuucgaggaguucaagaagcugauccggaaccggcagagcgaggccgccgauagcuccccuagcgagcucaaguaccugggccuggacacccacagcagaaagaagcgccagcuguauagcgcccuggccaacaagugcugccacgugggaugcacaaaaagaagcuuggcccgguucugc

SEQ ID NO: 384 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccucuccuccgucccccgcucccgagcugcugggcggcagcagcguguuccuguucccucccaagcccaaggacacccuguacaucacccgggagcccgaggugaccugcguggugguggacgugagccacgaggacccugaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccagccccuaucgagaagaccaucagcaaggccaaggggcagcccagggagccacagguguacacccugccgcccagccgggacgagcugaccaagaaccaggugagccugaccugccuggugaagggcuucuaccccagcgacaucgcuguggagugggagagcaacggccagccggagaacaacuacaagaccaccccacccgugcuggacagcgacggcagcuucuuccuguacagcaagcucaccguagacaagagccgguggcagcagggcaacguguucagcugcagcgugaugcacgaggcccuacacaaccacuacacccagaaaagccugagccuaucccccggcaagcggaagaagagaucgcugagccaggaggacgccccccagaccccccggcccguagccgagaucgugcccagcuucaucaacaaagacacugaaacgaucaacaugaugagcgaguucguggccaaccugccccaggagcugaagcucacacugagcgagaugcagcccgcucugccacagcuccagcagcacgugcccguccugaaggacagcagccugcuuuucgaggaguucaagaagcugauccggaaccggcagagcgaggccgcugacagcucacccagugaacuuaaguaccugggccuggacacccacagccgcaagaagcggcagcuguacuccgcccuggccaacaagugcugccacguggggugcaccaaacgcagccuggcccgguucugc

SEQ ID NO: 385 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccuccccaccuagcccagcccccgagcugcugggcggcagcagcguguuccuguucccacccaagcccaaggacacccuguacaucacccgggagcccgaggugaccugcguggugguggacgugagccacgaggaccccgaggucaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugcccgcucccaucgagaagaccaucagcaaggccaagggccagcccagggagccccagguguacacccugccucccagccgggacgagcugaccaagaaccaggugagccugaccugccuggugaagggcuucuaccccagcgacaucgcugucgagugggagagcaacggacagcccgagaacaacuacaagaccaccccucccgugcuggacagcgacggcagcuucuuccuguacagcaaacugacuguggacaagagccgguggcagcagggcaacguguucagcugcagcgugaugcacgaggccuugcacaaccacuacacccagaaaagccugucccugucccccggcaagcggaagaagcggucacugucccaggaggacgcuccgcagaccccccggccaguggcggagaucgugcccagcuucaucaauaaggauaccgagacaauuaacaugaugagcgaguucguggccaaccugccccaggagcugaagcugacccugagcgagaugcagcccgcucugccgcaguuacagcagcacgugcccguccugaaggacagcagccugcuguuugaggaguucaagaagcugauccggaaccggcagagcgaggccgccgauagcuccccaucugagcucaaguaccugggccuggacacccacagcagaaagaaaaggcagcuguacuccgcccuggccaacaagugcugccacgugggaugcaccaagagaucucuggcccgguucugc

SEQ ID NO: 386 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccucaccuccauccccggcacccgagcugcugggcggcagcagcguguuccuguucccucccaagcccaaggacacccuguacaucacccgggagcccgaggugaccugcguggugguggacgugagccacgaggaccccgaagugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugcgccuaucgagaagaccaucagcaaggccaagggccagccacgggaaccccagguguacacccugccucccagccgggacgagcugaccaagaaccaggugagccugaccugccuggugaagggcuucuaccccagcgauaucgcuguggagugggagagcaacggccaacccgagaacaacuacaagaccaccccacccgugcuggacagcgacggcagcuucuuccuguacagcaaacuaaccguggacaagagccgguggcagcagggcaacguguucagcugcagcgugaugcacgaagcccugcacaaccacuacacccagaaaagccucucccugagccccggcaagcggaagaagcgguccuugucacaggaggacgccccccagaccccccggcccgucgcugagaucgugcccagcuucaucaacaaagacaccgaaacaauuaacaugaugagcgaguucguggccaaccugccccaggagcugaagcugacacugagcgagaugcagcccgcucugccacaacugcagcagcacgugccagugcucaaggacagcagccuccuguucgaggaguucaagaagcugauccggaaccggcagagcgaggccgcggacagcucaccaagcgagcugaaauaccugggccuggacacccacagccgcaaaaagagacagcuguacuccgcccuggccaacaagugcugccacgugggaugcaccaaaagaagccuggcccgguucugc

SEQ ID NO: 387 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccagccccccuucccccgcccccgagcugcugggcggcagcagcguguuccuguucccgcccaagcccaaggacacccuguacaucacccgggagcccgaggugaccugcguggugguggacgugagccacgaggaccccgaagugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugcccgcucccaucgagaagaccaucagcaaggccaagggccagccaagagaaccccagguguacacccugccccccucccgggacgagcugaccaagaaccaggugagccugaccugccuggugaagggcuucuaccccagcgacauugccguggagugggagagcaacggccagcccgagaacaacuacaagaccaccccacccgugcuggacagcgacggcagcuucuuccuguacagcaagcugacuguggacaagagccgguggcagcagggcaacguguucagcugcagcgugaugcacgaggccuugcacaaccacuacacccagaaaagccugucccuuagccccggcaagcggaagaagaggagccuuagccaggaggacgccccacagaccccccggcccguggcugaaaucgugcccagcuucaucaacaaagacacagaaaccaucaacaugaugagcgaguucguggccaaccugccccaggagcugaagcucacccugagcgagaugcagcccgcauugccacagcuccagcagcacgugccugugcugaaggacagcagcuugcucuuugaggaguucaagaagcugauccggaaccggcagagcgaggccgccgacuccagccccucugaguuaaaguaccugggccuggacacccacagcagaaagaagcggcagcuguacucagcccuggccaacaagugcugccacgugggcugcacaaagcggagccuggcccgguucugc

SEQ ID NO: 388 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccagccccccaagccccgcccccgagcugcugggcggcagcagcguguuccuguucccgcccaagccaaaggacacccuguacaucacccgggagcccgaggugaccugcguggugguggacgugagccacgaggacccagaagucaaguucaacugguacguggacggcguggaggugcacaacgccaagaccaagccacgggaggagcaguacaacagcaccuaccggguggugagcgugcugaccgugcugcaccaggacuggcugaacggcaaggaguacaagugcaaggugagcaacaaggcccugccugcacccaucgagaagaccaucagcaaggccaaggggcagccuagagagccccagguguacacccugccaccuagccgggacgagcugaccaagaaccaggugagccugaccugccuggugaagggcuucuaccccagcgacaucgcuguggagugggagagcaacggccagccugagaacaacuacaagaccaccccgcccgugcuggacagcgacggcagcuucuuccuguacagcaagcucacgguagacaagagccgguggcagcagggcaacguguucagcugcagcgugaugcacgaagcucugcacaaccacuacacgcagaaaagcuugagccugucacccggcaagcggaagaagcggucccugucccaggaggacgccccucagaccccccggccaguagcggagaucgugcccagcuucaucaacaaggauacagagacuaucaacaugaugagcgaguucguggccaaccugccccaggagcugaagcugacucugagcgagaugcagcccgcgcugccucaacugcagcagcacgugcccguacugaaggacagcagcuugcucuuugaggaguucaagaagcugauccggaaccggcagagcgaggccgcagacagcucacccagcgaauugaaguaccugggccuggacacccacagcagaaagaagcgacaguuguacuccgcccuggccaacaagugcugccacguggguugcaccaagaggucgcuggcccgguucugc

SEQ ID NO: 389 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccucaccaccaagcccugcacccgagcugcugggcggcagcagcguguuccuguucccucccaagcccaaggacacccuguacaucacccgggagcccgaggugaccugcguggugguggacgugagccacgaggacccagaggucaaguucaacugguacguggacggcguggaggugcacaacgccaagaccaaaccccgggaggagcaguacaacagcaccuaccggguggugagcgugcugaccgugcugcaccaggacuggcugaacggcaaggaguacaagugcaaggugagcaacaaggcccugccggccccuaucgagaagaccaucagcaaggccaagggccagccaagggaaccccagguguacacccugccacccagccgggacgagcugaccaagaaccaggugagccugaccugccuggugaagggcuucuaccccagcgacaucgcaguggagugggagagcaacggccagcccgagaacaacuacaagaccaccccacccgugcuggacagcgacggcagcuucuuccuguacagcaagcugacugucgacaagagccgguggcagcagggcaacguguucagcugcagcgugaugcacgaggccuugcacaaccacuacacccagaaaagccucucucuuucucccggcaagcggaagaagaggagccugucccaggaggacgccccccaaacuccccggcccgucgcugagaucgugcccagcuucaucaauaaagacacggagacaaucaacaugaugagcgaguucguggccaaccugccccaggagcugaagcugacacugagcgagaugcagcccgcacuuccccagcuccagcagcacgugcccguccugaaggacagcagcuuacucuucgaggaguucaagaagcugauccggaaccggcagagcgaggccgcagauucuagccccuccgaacucaaauaccugggccuggacacccacagcagaaagaaaagacagcuguauucagcccuggccaacaagugcugccacgugggcugcacaaagcggagccucgcccgguucugc

SEQ ID NO: 390 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccuccccucccaguccugcccccgagcugcugggcggcagcagcguguuccuguucccgcccaagcccaaggacacccuguacaucacccgggagcccgaggugaccugcguggugguggacgugagccacgaggacccugaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugcccgccccaaucgagaagaccaucagcaaggccaagggccagccuagggagccgcagguguacacccugccacccucucgggacgagcugaccaagaaccaggugagccugaccugccuggugaagggcuucuaccccagcgauaucgccgucgagugggagagcaacggccaaccugagaacaacuacaagaccaccccucccgugcuggacagcgacggcagcuucuuccuguacagcaagcucaccguggacaagagccgguggcagcagggcaacguguucagcugcagcgugaugcacgaagcccugcacaaccacuacacccagaaaagcuugagccucagucccggcaagcggaagaagcgauccuugagccaggaggacgcuccucagaccccccggccuguggcggagaucgugcccagcuucaucaacaaagacacugaaaccauuaacaugaugagcgaguucguggcuaacuugccccaggagcugaagcugacucugagcgagaugcagcccgcucucccgcagcuucagcagcacgugcccguguugaaggacagcagccuccucuucgaggaguucaagaagcugauccggaaccggcagagcgaggccgcugauucuuccccuagcgaacugaaauaccugggccuggacacccacagcagaaagaagaggcagcuguacucugcccuggccaacaagugcugccacgugggcugcacaaagaggagccuggcccgguucugc

SEQ ID NO: 391 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccuccccuccgucccccgcucccgagcugcugggcggcagcagcguguuccuguucccucccaagcccaaggacacccuguacaucacccgggagcccgaggugaccugcguggugguggacgugagccacgaggacccagaagucaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugcuccuaucgagaagaccaucagcaaggccaagggccagccucgggaaccccagguguacacccugcccccuagccgggacgagcugaccaagaaccaggugagccugaccugccuggugaagggcuucuaccccagcgauauugccguggagugggagagcaacgggcagcccgagaacaacuacaagaccaccccgcccgugcuggacagcgacggcagcuucuuccuguacagcaagcuuaccgucgacaagagccgguggcagcagggcaacguguucagcugcagcgugaugcacgaagcccugcacaaccacuacacccagaaaagccucucccugucucccggcaagcggaagaagcgcagucucucucaggaggacgcuccucagaccccccggcccgucgccgaaaucgugcccagcuucaucaacaaagacacugaaaccauaaacaugaugagcgaguucguggccaaccugccccaggagcugaaguugacucugagcgagaugcagcccgcccugccacagcuccagcagcacgugcccguccugaaggacagcagccuguuguucgaggaguucaagaagcugauccggaaccggcagagcgaggccgccgauuccagccccucugagcucaaguaccugggccuggacacccacagccggaagaaaaggcaguuauacagcgcccuggccaacaagugcugccacgugggauguaccaagaggagucuggcccgguucugc

SEQ ID NO: 392 - RNA, 1236 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgagcccaagagcagcgacaagacccacaccaguccccccucucccgcacccgagcugcugggcggcagcagcguguuccuguucccucccaagcccaaggacacccuguacaucacccgggagcccgaggugaccugcguggugguggacgugagccacgaggaccccgaggucaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccggcgccaaucgagaagaccaucagcaaggccaagggucagcccagggagccccagguguacacccugccucccucucgggacgagcugaccaagaaccaggugagccugaccugccuggugaagggcuucuaccccagcgacaucgcuguggagugggagagcaacggccagcccgagaacaacuacaagaccaccccucccgugcuggacagcgacggcagcuucuuccuguacagcaagcugacaguggacaagagccgguggcagcagggcaacguguucagcugcagcgugaugcacgaggccuugcacaaccacuacacccagaaaagccugagccucucccccggcaagcggaagaagaggagccucagccaggaggacgcuccccagaccccccggccaguggccgaaaucgugcccagcuucaucaacaaggauacagagacaauuaacaugaugagcgaguucguggccaaccugccccaggagcugaagcucacacugagcgagaugcagcccgcccugccacaguugcagcagcacgugcccguacucaaggacagcagccuccuuuucgaggaguucaagaagcugauccggaaccggcagagcgaggccgccgacaguagcccaagcgaacucaaguaccugggccuggacacccacagcaggaaaaagagacagcuguauagcgcccuggccaacaagugcugccacgugggcuguaccaagcggagcuuggcccgguucugc

SEQ ID NO: 393 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcggaggugguggcucaggcggcgggggauccggcgguggugguagcggcggaggcgggucugguggcggcgguucagggggagggggcagugggggaggaggcucuuuccagagcuccuccuccaaggccccacccccuagccugcccagccccagccggcugcccggccccagcgacacccccauccugccccaaggaggggguggcuccgggggcgguggaucggguggaggcggcucagguggcggggguucuggggggggcggaucuggcggaggagggucggggggugggggaucacagcuguacagcgcccuggccaacaagugcugccacgugggcugcaccaagcggagccuggcccgguucugc

SEQ ID NO: 394 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcggcggcggggggucagggggaggaggguccgggggaggcgggagcgguggaggcggcuccggugguggggguucuggcggcgguggcagugggggagggggauccuuccagagcucauccuccaaggcuccucccccgagccugcccagccccagccggcugcccggccccagcgacacccccauccugccccaggggggcggcggcucaggcgggggugguaguggcggaggaggaucuggagggggcgggucaggaggggguggaagcgggggggguggcucugguggcgggggcucucagcuguacagcgcccuggccaacaagugcugccacgugggcugcaccaagcggagccuggcccgguucugc

SEQ ID NO: 395 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcggaggggguggaucuggggggggcggcagcggugggggcggguccggcggagguggaaguggcgggggggguucaggagggggaggcucuggaggcggaggaaguuuccagagcuccuccucaaaggcgccucccccaagccugcccagccccagccggcugcccggccccagcgacacccccauccugccccaagguggcggugguagcggggguggugggucaggcggcggcggaucggguggcggagggucugguggaggugggagcggcgggggcgguagcggcgguggcggcucccagcuguacagcgcccuggccaacaagugcugccacgugggcugcaccaagcggagccuggcccgguucugc

SEQ ID NO: 396 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgguggcggcggaucuggcgguggggggucgggugggggagguuccgggggaggcgguucagggggcgggggcucaggcggugguggaagugggggcggcggcaguuuccagagcuccagcuccaaggccccgccucccagccugcccagccccagccggcugcccggccccagcgacacccccauccugccccagggagggggagggucaggaggcggaggguccggggguggaggaucgggagguggcgguagcggcggggggggcagcggaggcgggggaucuggugguggggguucucagcuguacagcgcccuggccaacaagugcugccacgugggcugcaccaagcggagccuggcccgguucugc

SEQ ID NO: 397 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcggcggcgguggcagugggggcggagggucugguggugggggcucuggcgggggaggaaguggagggggcggcucuggagguggaggcucaggugggggugggagcuuccagagcucuagcagcaaggcgccacccccaagccugcccagccccagccggcugcccggccccagcgacacccccauccugccccagggcggcggagguucugggggaggggguuccggcggggggggcagcggagggggggguagcggggguggcgggagcggaggagggggauccgguggcggaggaucccagcuguacagcgcccuggccaacaagugcugccacgugggcugcaccaagcggagccuggcccgguucugc

SEQ ID NO: 398 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgguggaggggggucagggggagggggcuccggcgggggaggcucgggaggaggcgguucaggugggggcggcucugguggaggcggauccgguggcggggggagcuuccagagcagcucguccaaggccccucccccaagccugcccagccccagccggcugcccggccccagcgacacccccauccugccccagggugggggaggaagcggaggugguggcuccgggggcgguggcaguggcggaggggguucuggggggggcgggucggguggagguggaagcgggggugguggaucccagcuguacagcgcccuggccaacaagugcugccacgugggcugcaccaagcggagccuggcccgguucugc

SEQ ID NO: 399 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgggggugguggaucagguggaggcggcaguggcgggggcgguucugggggaggagggucgggaggggggggaucuggugguggcggaaguggcggcgguggauccuuccagagcaguagcucuaaggccccaccgcccagccugcccagccccagccggcugcccggccccagcgacacccccauccugccccaggguggggguggcuccggcggcggaggcucugggggcggcgggagcggagggggcgggucaggcggggggggcucagggggagguggguccgguggagguggaagucagcuguacagcgcccuggccaacaagugcugccacgugggcugcaccaagcggagccuggcccgguucugc

SEQ ID NO: 400 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcggcggagguggaucaggcggcgguggguccggggguggcgggucagggggcggaggguccggcggcgggggaagcgguggcgguggcuccggaggaggaggcucuuuccagagcuccucaucuaaggccccgccgcccagccugcccagccccagccggcugcccggccccagcgacacccccauccugccccagggcgguggaggcaguggugggggagggaguggaggcggggggagugggggcggggguucgggugguggagguagcgggggcggcggaucugguggcggaggaagccagcuguacagcgcccuggccaacaagugcugccacgugggcugcaccaagcggagccuggcccgguucugc

SEQ ID NO: 401 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcgggggaggugggucagguggcgggggauccggcggaggggguucaggaggcggcgggagcggagguggugguucggguggaggggggagcgguggcggaggaagcuuccagagcuccuccucuaaggccccgcccccuagccugcccagccccagccggcugcccggccccagcgacacccccauccugccccaggggggcgguggaagcggcgggggcggaucugggggugggggcucuggugggggagggaguggggggggaggcucagggggugguggcucugggggcggcggcucacagcuguacagcgcccuggccaacaagugcugccacgugggcugcaccaagcggagccuggcccgguucugc

SEQ ID NO: 402 - RNA, 510 nt, Artificial Sequence
  Synthetic Polynucleotide
augggcgugaaggugcuguucgcccugaucugcaucgccguggccgaggccgacagcuggauggaggaggugaucaagcugugcggccgggagcuggugcgggcccagaucgccaucugcggcaugagcaccuggagcggcggaggcggaagcggcggggggggcagugguggaggugguucugguggcgggggaucuggaggcggcgggucaggcggugggggcagcggaggagggggcucuuuccagagcuccucaucuaaggcuccucccccaagccugcccagccccagccggcugcccggccccagcgacacccccauccugccccagggagggggagggagugggggcggcggcucuggggguggaggcucagggggcggaggaagcggagggggugguagcgggggcggggguagugggggggguggcucccagcuguacagcgcccuggccaacaagugcugccacgugggcugcaccaagcggagccuggcccgguucugc

SEQ ID NO: 403 - RNA, 1236 nt, Artificial Sequence; identical to SEQ ID NO: 367
  Synthetic Polynucleotide

SEQ ID NO: 404 - RNA, 1257 nt, Artificial Sequence
  Synthetic Polynucleotide
augcccagacuguucuucuuccaccugcugggcgugugccuguuacuuaaccaguucagcagagccguggccgacagcuggauggaggaggugaucaagcugugcggcagagagcuggugagagcccagaucgccaucugcggcaugucuaccuggagcgagcccaagagcagcgacaagacccacaccagcccccccagccccgcccccgagcugcugggcggcagcagcguguuccuguucccccccaagcccaaggacacccuguacaucaccagagagcccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacgggaaggaguacaagugcaaggugagcaacaaggcccugcccgcccccaucgagaagaccaucagcaaggccaagggccagcccagagagccccagguguacacccugccccccagccgagacgaacugaccaagaaucaggugagccugaccugccuggugaagggcuucuaccccagcgacaucgccguggagugggaaagcaacggccagcccgagaacaacuacaagaccaccccccccgugcuggacagcgacggcagcuucuuccuguauagcaagcugaccguggacaagucaagauggcagcagggcaacguguucagcugcagcgugaugcacgaggcccugcacaaccacuacacccagaagagccugagccugagccccggcaagagaaagaagagaagccugagccaggaggacgccccccagacaccuagacccguggccgagaucgugcccagcuuuaucaacaaggacaccgagaccaucaacaugauguccgaguucguggccaaccugccccaggagcugaagcugacccugagcgagaugcagcccgcccugccccagcugcagcagcacgugccagugcugaaggacagcagccugcuguucgaggaguucaagaagcugaucagaaacagacagagcgaggccgccgacagcagccccagcgagcugaaguaccugggccuggacacccacagcagaaagaagagacaacuguacagcgcccuggccaauaagugcugccacgugggcugcaccaagagaagccuggccagauucugc

SEQ ID NO: 405 - RNA, 531 nt, Artificial Sequence
  Synthetic Polynucleotide
augccuagguuguuuuucuuucacuuacuaggaguauguuuacuccugaaucaauuuucuagggcugucgcagauaguuggauggaggagguaaucaaauuauguggaagagaguuaguucgugcucaaauagcuauuugugguaugucaacuuggagcggagggggcggcucgggcggagggggaagcggaggggguggcucaggagggggcgguucugguggcggcggaucaggugguggaggaucaggaggcgggggcagcuuucagucgucgucauccaaagcgccuccacccucacugcccucccccuccagauuaccugggcccuccgauacccccauuuugccacaaggggguggaggauccggggggggaggcaguggugguggugguagcgguggugggggcuccgguggaggcggaaguggugggggaggauccggggggggcggaucgcagcucuauuccgcucuugccaauaaauguugccacgucgguuguacaaaacggucccuggccagauucugc

SEQ ID NO: 406 - RNA, 1257 nt, Artificial Sequence; identical to SEQ ID NO: 404
  Synthetic Polynucleotide

SEQ ID NO: 407 - RNA, 1236 nt, Artificial Sequence; identical to SEQ ID NO: 369
  Synthetic Polynucleotide

SEQ ID NO: 408 - RNA, 1257 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaagaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 409 - RNA, 1257 nt, Artificial Sequence; identical to SEQ ID NO: 408
  Synthetic Polynucleotide

SEQ ID NO: 410 - RNA, 918 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcgaggugcagcugcuggagagcggcggcggccuggugcagcccggcggcagccugaggcugagcugcguggccagcggcuucaccuucaacagcagcgccaugagcugggugaggcaggcccccggcaagggccuggagugggugagcgccaucagcggcagcggcgacaggaccuacuacgccgacagcgugaagggcagguucaccaucagcagggacaacagcaagaacacccuguaccugcagaugaacagccugagggccgaggacaccgccguguacuacugcaccaccgacccccccagguaccacuacaacggccuggccgugaggggccagggcaccaccgugaccgugagcagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 411 - RNA, 918 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcgaggugcagcugcuggagagcggcggcggccuggugcagcccggcggcagccugaggcugagcugcgccgccagcggcuucaccuucagcagcuacgccaugagcugggugaggcaggcccccggcaagggccuggagugggugagcgccaucagcggcagcggcggcagcaccuacuacgccgacagcgugaagggcagguucaccaucagcagggacaacagcaagaacacccuguaccugcagaugaacagccugagggccgaggacaccgccguguacuacugcaccaaggacccccccagguaccacuacaccggccuggccgugaggggccagggcaccaccgugaccgugagcagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 412 - RNA, 531 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccugguccgggucgaccgauagcgguuccgacacuuccuccggaaacuccggggacggcaacagcggcuuccagucgagcuccucaaaggccccaccucccucacugcccuccccuucucggcucccuggaccguccgauacuccgauccugccgcaauuccaguccagcagcuccaaggccccuccaccgucacugccauccccgucgagguugccgggacccucagacacgcccauccugccucagggcagcaccgacucgggauccgauaccucguccgggaacuccggcgacgggaacucgggacaacucuacagugcauuggcuaauaaauguugccauguugguuguaccaaaagaucucuugcuagauuuugc

SEQ ID NO: 413 - RNA, 441 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccugguccggaggaggaggguccuuccagucaagcagcuccaaggccccuccaccaagccucccuagcccguccaggcuuccgggaccgucggauacucccauccugccccaguuccaguccucgucguccaaggcucccccuccaucccugcccucacccucacggcugccaggaccguccgacaccccuauccugccgcaaggcgguggagggucacaacucuacagugcauuggcuaauaaauguugccauguugguuguaccaaaagaucucuugcuagauuuugc

SEQ ID NO: 414 - RNA, 1257 nt, Artificial Sequence
  Synthetic Polynucleotide
augccgagacuguucuucuuccaccuccucggcgugugccuccuccucaaccaguucucucgagccguggcggauagcuggauggaggaggugaucaagcucuguggccgugagcucguccgggcccagaucgccaucugcggcauguccaccugguccgagcccaaguccuccgacaagacccacaccucgccccccagcccugcccccgagcuccugggcggcagcuccgucuuccuguucccgcccaagccgaaggauacccuguacaucaccagggagcccgaggugaccugugucgugguggacgugagccacgaggaccccgaggugaaguuuaauugguacgucgacggcguggaggugcacaacgccaagaccaagcccagggaggagcaguacaacuccaccuaccggguggugagcgugcugacaguccugcaucaggacuggcugaacggcaaggaauacaagugcaaggugagcaacaaggcccugcccgcccccaucgagaagaccaucagcaaggccaagggccaaccccgggaaccccaggucuacacccugccucccagcagggaugagcugaccaagaaccagguuagccugaccugccuggucaagggcuucuaccccuccgacauugccguggagugggagagcaacggucagcccgagaacaacuacaagaccaccccucccgugcucgacagcgacgguuccuucuuccuguacagcaagcugacgguggacaagagccgcuggcagcagggcaacguguucagcugcuccgugaugcacgaagcccugcacaaccacuacacccagaagucccugagccugucacccggcaagaggaagaagcggagccugucccaggaggaugccccccagaccccuagaccuguggccgaaauugugcccuccuuuaucaacaaggacaccgaaaccaucaauaugauguccgaguucguggccaaccugccccaggagcugaaacucacccugagcgagaugcagcccgcccugccccagcugcaacagcacgugcccgugcugaaggacucaucucugcuguucgaggaauucaagaagcugaucaggaacaggcagagcgaggccgccgacagcagucccagcgagcugaaauaccugggccuggacacccacucccgcaagaagcggcagcuguacagcgcccuggccaacaagugcugccacguaggcugcaccaaacgcagccuggcacgguucugc

SEQ ID NO: 415 - RNA, 1257 nt, Artificial Sequence
  Synthetic Polynucleotide
augccccgucucuucuucuuccaccuccucggagugugccuccuccucaaccaguucagcagggccguggccgacuccuggauggaggaagugaucaagcucugcggcagggagcucgugagggcccaaaucgccaucugcggcaugagcaccugguccgagcccaagagcuccgacaagacucacaccagccccccgagccccgcccccgagcugcugggcgggagcagcguguuucuguucccucccaagcccaaggacacccuguacaucacccgcgagccggaagugaccugcguggugguggacgucucccacgaggaccccgaggugaaauucaacugguacguggacggcguggaagugcacaaugcgaagaccaagcccagggaggagcaguacaacagcaccuacaggguagucagcgugcugaccgugcugcaucaggacuggcugaauggcaaggaguacaagugcaaaguguccaauaaggcucugcccgcccccaucgagaagaccaucagcaaagccaagggacagcccagagagccccagguguacacccugcccccgagcagggacgagcugaccaagaaccaggucagccugaccugccuggugaagggguuuuaccccagcgacaucgccguggagugggagagcaacggccagcccgagaacaacuacaagacgacacccccggugcuggacagcgacgggucuuucuuccuguacagcaagcugaccguggauaaauccagauggcagcagggcaacgucuucagcugcuccgugaugcaugaggcccugcacaaccacuacacgcagaagucacugucccugagccccggcaagaggaagaagcggagccugagccaggaggacgccccccagaccccccggcccguggcggagaucgugccuagcuucaucaacaaggacaccgagacuaucaacaugaugagcgaguucguggccaaccugccccaggagcugaagcucacccuguccgaaaugcagccggcccucccgcagcugcagcagcacguacccgugcugaaagauuccagucugcuguuugaggaguucaagaagcugaucaggaaucggcaguccgaggccgccgacagcagcccguccgaguugaaguaccucggccuggauacccauucgcggaagaagaggcaacuguacuccgcccuggccaacaagugcugucacguggggugcacaaagagaagccuggcccguuucugc

SEQ ID NO: 416 - RNA, 1257 nt, Artificial Sequence
  Synthetic Polynucleotide
augcccaggcuguucuucuuccaccuccucggcgugugucuccuccucaaccaauuuagccgugccguggcggacagcuggauggaggaggugaucaagcucugugguagagagcucguccgugcccagauugccaucuguggcauguccaccuggagcgagcccaaguccagcgacaagacccacaccagcccgcccagcccugcccccgagcugcugggcggcagcagcguguuccuguucccgcccaagcccaaggacacacuguacauaacccgggagcccgaggugaccugugugguggucgacgucagccacgaggaccccgaggucaaauucaacugguacguggacggcguggaggugcacaacgccaagacuaaaccccgggaggaacaauacaacuccaccuacagggugguauccgugcugaccguccugcaccaggauuggcucaacggcaaagaguauaagugcaaaguguccaacaaggcccugcccgcccccaucgagaagacgaucagcaaggccaagggccagccccgggagccccaggucuacacgcugccccccagcagagacgagcuuaccaagaaccagguuucccugaccugccuggugaagggcuucuacccgagcgacauugccguggagugggagagcaacggccagcccgagaauaacuacaagaccacgccccccgugcucgacuccgacggcagcuucuuucucuacuccaagcugaccguugacaagagccgcuggcagcagggaaacguguucagcugcagcgucaugcacgaggcccugcacaaccacuacacgcagaagucccugagccugucccccggcaaacguaagaagaggagccugagccaggaggacgccccccagacccccaggccaguggccgagaucguccccuccuucauaaacaaggacaccgaaaccaucaacaugaugagcgaguucguggccaaccugccccaggagcugaagcugacccucagcgagaugcagcccgcccucccccaacuccagcagcacgugcccgugcucaaggacagcagccugcuguuugaggaguucaagaaacugauccgcaacagacagagcgaggccgccgacagcagccccagcgagcucaaguaccugggucuggacacccauagcaggaagaagaggcagcuguacagugcccuggcgaacaagugcugccacgugggcugcaccaagaggagccuugccagguucugc

SEQ ID NO: 417 - RNA, 1257 nt, Artificial Sequence
  Synthetic Polynucleotide
augccgagacuuuucuucuuccacuugcucggcgugugccuccuccuuaaccaauuuagcagagccguggcagacuccuggauggaggaggugaucaagcucugcggcagggagcucgugagggcgcagaucgccauuugcgguauguccacauggagcgagcccaagagcucagauaagacccacaccagcccucccagccccgcccccgagcugcugggcggcagcagcguguuccucuucccgcccaaacccaaggacacccuguacaucaccagggagcccgaggugaccugcguggucgucgacguaucccacgaggaccccgaggugaaguucaacugguacguggacgggguggaggugcauaacgccaagaccaagccccgggaggagcaguacaacagcaccuaccgggugguguccgugcugacaguccugcaccaggacuggcugaacggcaaggaguacaagugcaaggucagcaacaaagcccugcccgcccccaucgagaagaccaucucaaaggccaaggggcagccccgcgagccacagguguauacgcugccgcccagcagagacgagcugaccaagaaccaggugagccugaccugccuggucaagggcuucuaucccagcgacaucgccguugagugggagagcaacggccagcccgagaacaacuauaagaccacuccacccguccuggacagcgaugggagcuucuuccuguacuccaagcugaccguggacaagagccgcuggcagcagggcaauguguucagcugcuccgugaugcacgaggcccugcauaaccauuacacccagaagucgcugagccugagcccuggcaagaggaagaaacgcagccugagccaggaggaugccccgcagaccccucggccgguggccgagaucgugccuuccuucaucaacaaggacaccgagacaaucaacaugauguccgaguucguagccaaucugccccaggagcugaagcugacccucuccgagaugcagcccgcccugccccagcugcagcaacacgucccggugcucaaggacagcagccugcuguucgaggaguuuaagaagcugauccgcaacaggcaguccgaggccgccgauagcagccccagcgagcugaaguaccugggccucgacacacauagcaggaagaagcggcagcucuacuccgcccucgccaauaagugcugucacgugggcugcaccaagagaagccuggccagauuuugc

SEQ ID NO: 418 - RNA, 1257 nt, Artificial Sequence
  Synthetic Polynucleotide
augccccggcuguucuucuuccaccuccucggcgugugccuccuccucaaucaguucuccagggccgucgccgacuccuggauggaggaggugaucaagcucugcgggcgcgagcucgugagagcccagauugccaucugcggcauguccaccuggagcgagcccaagagcagcgacaagacccacaccuccccucccagccccgcgccggagcugcugggcggcagcagcguguuucuguucccucccaagcccaaggacacccuguacaucacuagggagcccgaggugaccugcguggucguggaugugagccacgaagauccagaggugaaguucaauugguacgucgacggcguggaggugcacaaugccaagaccaagcccagggaggagcaguacaacagcaccuacagggucguuuccgugcucaccgugcugcaccaggacuggcugaacggcaaggaguacaagugcaaggucagcaacaaagcccuacccgcccccaucgagaagacaaucagcaaagccaagggccagcccagggagccccagguguauacccucccacccuccagggacgaacugaccaagaaucaggucagccugaccugccuugucaagggcuuuuaccccagcgacaucgccguggagugggagagcaacggccaacccgagaacaauuacaagaccaccccgcccguccuggacuccgacggguccuucuuccuauacagcaagcugaccguggacaaguccagauggcagcaagggaacguguucuccugcuccgugaugcacgaggcccugcacaaucacuacacgcagaagagucugagccugagccccgggaagcggaagaagcgaucccugagccaggaggacgccccgcagacaccccgccccguggccgagauugugcccagcuucaucaacaaggacaccgagacgaucaauaugauguccgaguucguggccaaccugccacaggaacugaagcugacccugagcgaaaugcagccugcgcuuccgcagcugcaacaacauguccccgugcugaaggacagcagccugcuguuugaggaguucaagaagcugauaaggaaccggcagagcgaggccgccgacagcagccccagcgaacugaaguaccugggccuggacacccacagcagaaagaagaggcaacuguauagcgcacuggcuaauaagugcugucacgugggcugcaccaaacgcagccuggccagguucugc

SEQ ID NO: 419 - RNA, 1257 nt, Artificial Sequence
  Synthetic Polynucleotide
augcccagacuguucuucuuccaccuccucggggugugccuccuccucaaccaguucuccagggccguggccgacagcuggauggaggaggugaucaagcucugcggcagagagcucgucagggcccagaucgccaucugcgguaugagcacguggagcgagcccaagagcuccgacaagacccauacaagccccccgagccccgcgcccgaacuccuggggggcuccagcguguuucuguucccgcccaagcccaaagacacccuguacaucacccgggagccugaggugaccugcguggugguggacgugucccacgaagacccugaggugaaauucaacugguacguggacggcguggaggugcauaacgccaagaccaaaccgcgugaggagcaauacaacagcaccuaccggguggugucggugcugaccguccugcaccaggacuggcugaacggcaaggaguacaaguguaagguguccaacaaggcucuccccgcccccaucgagaagaccaucuccaaggccaagggccagccccgcgagccccagguguacacccucccgcccagccgcgacgagcugaccaagaaccaggugucccugaccugcuuggugaagggcuucuaccccagcgacaucgccguggaaugggaguccaacggccagccggagaacaacuacaagaccacuccccccguccuggacagcgacggcuccuucuuccuguacagcaagcugaccgucgacaagucccgcuggcagcaggggaacguguucuccugcagcgugaugcacgaggcccugcacaaccacuacacucagaagucucugucccuuagccccggcaagcggaagaagaggagccugagccaggaggacgccccccaaacgccucgccccguggccgagauugugcccagcuucaucaacaaggacaccgaaaccaucaauaugauguccgaguucguggccaaccugccccaggagcugaagcugacccuguccgagaugcagcccgcccugccccagcugcagcagcacgugcccgugcugaaggacagcagccugcuguucgaggaguuuaagaagcugaucagaaacagacaauccgaggcagccgacuccucccccagcgagcugaaauaccugggccuggacacccauucccggaagaagcggcagcuguacagcgcccucgccaacaagugcugccacgugggcugcaccaagagaagccuggccagguucugc

SEQ ID NO: 420 - RNA, 1257 nt, Artificial Sequence
  Synthetic Polynucleotide
augccccgccuguucuucuuccaccuccucggcgugugucuccuccuuaaccaguucucccgugccguggccgauagcuggauggaggaggugaucaagcucugcggccgagagcucgugagggcacagaucgccaucuguggcauguccaccuggagcgaacccaagagcuccgauaagacccacaccagccccccuucucccgcccccgagcugcucggcggcagcucgguguuccuguucccacccaaacccaaggacacccucuacaucaccagagagcccgagguaaccuguguggucguggaugugucccacgaggaccccgaggugaaguucaacugguacguggacgggguggaggugcacaacgccaagaccaagccccgcgaggagcaguacaacagcaccuaccgcguggugagcgugcugacagugcugcaccaggauuggcugaacggcaaggaguacaagugcaaggugagcaauaaggcccugcccgcccccaucgagaagaccaucagcaaggccaaagggcagcccagagaaccccagguguacacccugccccccagccgggacgagcugaccaagaaccaagugagccucaccugccuggugaagggguucuaccccagcgacaucgccguggagugggagagcaacggccagcccgagaacaacuacaagaccacgccucccgugcuggacuccgacgggagcuucuuccuguacagcaagcugaccguggacaagagccgcuggcaacaggggaacguguuuagcuguagcgucaugcacgaggcccugcacaaucacuacacccagaagucccugagccugucccccggcaagaggaagaagcguucccugagccaggaggacgccccccagacacccaggccggucgcagagaucgugcccuccuucaucaacaaggacaccgagacaaucaacaugaugagcgaguucguggccaaccugccccaggaacugaagcucacccuguccgagaugcagcccgcccugccccagcuacagcagcacguacccgugcugaaggacagcagccugcuguucgaggaguucaagaagcugauaaggaaucgccaguccgaggccgccgacucauccccuagcgagcugaaguaccucggucuggacacccacagccguaagaagaggcagcuguauuccgcccuggccaacaaaugcugccaugugggcugcaccaagagaagccuggcccgguucugc

SEQ ID NO: 421 - RNA, 1257 nt, Artificial Sequence
  Synthetic Polynucleotide
augccccggcuuuucuucuuccacuuacucggcgugugccuucuccuuaaccaguucagccgggccguggccgacagcuggauggaggaggugaucaagcucugcggccgggagcucgugcgggcccagaucgccaucugcggcaugagcaccuggagcgagcccaagagcagcgacaagacccacaccaguccaccguccccugcccccgaguuacugggcggcagcagcguguuccuguucccaccaaagcccaaggacacccuguacaucacccgggagcccgaggugaccugcguggugguggacgugagccacgaggacccugaggucaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugccccgaucgagaagaccaucagcaaggccaagggccagccucgcgagccucagguguacacccugccaccaagccgggacgagcugaccaagaaccaggugagccugaccugccuggugaagggcuucuaccccagcgacaucgccguggagugggagagcaacggccagccagagaacaacuacaagaccacaccacccgugcuggacagcgacggcagcuucuuccuguacagcaagcugacaguggacaagagccgguggcagcagggcaacguguucagcugcagcgugaugcacgaggcccuacacaaccacuacacccagaagucccugucucugucacccggcaagcggaagaagagaucccugagccaggaggacgccccgcagaccccccggccaguggccgagaucgugcccagcuucaucaacaaggauaccgagacgaucaacaugaugagcgaguucguggccaaccugccccaggagcugaagcucacacugagcgagaugcagcccgcccugccgcaacuccagcagcacgugccagugcugaaggacagcagccugcuguucgaggaguucaagaagcugauccggaaccggcagagcgaggccgcugacagcucuccuagcgaacugaaguaccugggccuggacacccacagcaggaagaagcggcagcuguacucagcccuggccaacaagugcugccacgugggcugcacuaagagaagccucgcccgguucugc

SEQ ID NO: 422 - RNA, 1257 nt, Artificial Sequence
  Synthetic Polynucleotide
augcccagacuguucuucuuccaccuccucggcgugugccuccuccucaaccaguucagccgggccguggccgacagcuggauggaggaggugaucaagcuaugcggccgggagcucgugcgggcccagaucgccaucugcggcaugagcaccuggagcgagcccaagagcagcgacaagacccacaccuccccgccguccccagcucccgagcuguuaggaggcagcagcguguuccuguucccgccuaagcccaaggacacccuguacaucacccgggagcccgaggugaccugcguggugguggacgugagccacgaggacccggaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugcaccuaucgagaagaccaucagcaaggccaagggccagccaagagagccucagguguacacccugccaccuagccgggacgagcugaccaagaaccaggugagccugaccugccuggugaagggcuucuaccccagcgacaucgccguggagugggagagcaacggccagccugagaacaacuacaagaccacuccacccgugcuggacagcgacggcagcuucuuccuguacagcaagcucaccguggacaagagccgguggcagcagggcaacguguucagcugcagcgugaugcacgaggcucugcacaaccacuacacccagaagagucugucgcugagccccggcaagcggaagaagagaagccugagccaggaggacgccccgcagaccccccggccaguggcagagaucgugcccagcuucaucaacaaggauaccgagacaauuaacaugaugagcgaguucguggccaaccugccccaggagcugaagcugacccugagcgagaugcagcccgcacugccucaguugcagcagcacgugccugugcugaaggacagcagccugcuguucgaggaguucaagaagcugauccggaaccggcagagcgaggccgccgacuccagcccaucugaacugaaguaccugggccuggacacccacagccgcaagaagcgccagcuguacucugcccuggccaacaagugcugccacgugggaugcacaaagcguucccuggcccgguucugc

SEQ ID NO: 423 - RNA, 1257 nt, Artificial Sequence
  Synthetic Polynucleotide
augccccggcuuuucuucuuccaccuccucggcgugugccuccuccucaaccaguucagccgggccguggccgacagcuggauggaggaggugaucaagcuuugcggccgggagcucgugcgggcccagaucgccaucugcggcaugagcaccuggagcgagcccaagagcagcgacaagacccacaccagcccaccuagcccggcacccgagcuccugggcggcagcagcguguuccuguucccuccaaagcccaaggacacccuguacaucacccgggagcccgaggugaccugcguggugguggacgugagccacgaggacccugaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccagccccuaucgagaagaccaucagcaaggccaagggccagccucgcgagccucagguguacacccugccuccaucccgggacgagcugaccaagaaccaggugagccugaccugccuggugaagggcuucuaccccagcgacaucgccguggagugggagagcaacggccagccagagaacaacuacaagaccaccccucccgugcuggacagcgacggcagcuucuuccuguacagcaaguugaccgucgacaagagccgguggcagcagggcaacguguucagcugcagcgugaugcacgaagcccuacacaaccacuacacccagaagucccugagcuugagccccggcaagcggaagaagcgcuccuugucccaggaggacgccccgcaaaccccccggccaguggccgagaucgugcccagcuucaucaacaaggauacagagacaauuaacaugaugagcgaguucguggccaaccugccccaggagcugaagcucacacugagcgagaugcagcccgcucugccacagcuccagcagcacgugccugugcugaaggacagcagccugcuguucgaggaguucaagaagcugauccggaaccggcagagcgaggccgccgacuccuccccaagcgagcucaaguaccugggccuggacacccacagcagaaagaagaggcagcucuacagcgcccuggccaacaagugcugccacgugggcuguaccaagagaagccuggcccgguucugc

SEQ ID NO: 424 - RNA, 1257 nt, Artificial Sequence
  Synthetic Polynucleotide
augcccagacuguucuucuuccacuuauugggcgugugcuugcuucucaaccaguucagccgggccguggccgacagcuggauggaggaggucaucaagcucugcggccgcgagcucguccgcgcccagaucgccaucugcggcauguccaccugguccgagcccaaguccuccgacaagacccacaccuccccgccuuccccugcacccgagcuccucggcggcuccuccgucuuccucuucccuccuaagcccaaggacacccucuacaucacccgcgagcccgaggucaccugcgucgucgucgacgucucccacgaggacccugaggugaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccugccugccccaaucgagaagaccaucuccaaggccaagggccagccacgggaaccucaggucuacacccugccuccuagccgcgacgagcucaccaagaaccaggugucccucaccugccucgucaagggcuucuacccuucugauaucgccgucgagugggaguccaacggucagccugagaacaacuacaagaccaccccucccguccucgacuccgacggcuccuucuuccuguacuccaagcugaccguggacaagucccgcuggcagcagggcaacgucuucuccugcuccgucaugcacgaggcucugcacaaccacuacacccagaagucccugagccugagccccggcaagcgcaagaagagaagccugucacaggaggacgccccccagaccccucgcccugucgccgagaucguccccuccuucaucaauaaggacacggagacaaucaacaugauguccgaguucgucgccaaccugccgcaggagcugaagcucacccucuccgagaugcagcccgcccuuccucagcuccagcagcacgugccuguccugaaggacuccucccuccucuucgaggaguucaagaagcucauccgcaaccgccaguccgaggccgccgauagcucgccuuccgagcuaaaguaccucggccucgacacccacucccggaagaagaggcagcuguauagcgcccucgccaacaagugcugccacgucggcugcaccaagaggagccuggcccgcuucugc

SEQ ID NO: 425 - RNA, 1257 nt, Artificial Sequence
  Synthetic Polynucleotide
augccccgucuguucuucuuccaccuucucggcgugugccuccuacucaaccaguucagccgggccguggccgacagcuggauggaggaggucaucaagcucugcggccgcgagcucguccgcgcccagaucgccaucugcggcauguccaccugguccgagcccaaguccuccgacaagacccacaccucgccuccuagcccagcccccgagcuccucggcggcuccuccgucuuccucuucccaccgaagcccaaggacacccucuacaucacccgcgagcccgaggucaccugcgucgucgucgacgucucccacgaggacccagaggugaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccugccagccccaaucgagaagaccaucuccaaggccaagggccaaccuagagagccucaggucuacaccuugccuccaagucgcgacgagcucaccaagaaccaggugucccucaccugccucgucaagggcuucuacccaagcgacaucgccgucgagugggaguccaacggccagccugagaacaacuacaagaccaccccgcccguccucgacuccgacggcuccuucuuccuguacuccaagcugaccgucgacaagucccgcuggcagcagggcaacgucuucuccugcuccgucaugcacgaggcucugcacaaccacuacacccagaagucccugagccugagccccggcaagcgcaagaagagaagccucagccaggaggacgccccccagaccccuagaccggucgccgagaucguccccuccuucaucaauaaggacacagagacaaucaacaugauguccgaguucgucgccaaucugccucaggagcuuaagcucacccucuccgagaugcagcccgcuuugccucagcuccagcagcacgugccugugcugaaggacuccucccuccucuucgaggaguucaagaagcucauccgcaaccgccaguccgaggccgccgacucaagcccauccgagcugaaguaccucggccucgacacccacucccggaagaagaggcagcucuacuccgcccucgccaacaagugcugccacgucggcugcaccaagcggucccucgcccgcuucugc

SEQ ID NO: 426 - RNA, 1257 nt, Artificial Sequence
  Synthetic Polynucleotide
augccccgguuguucuucuuccaccuuuugggcgugugccuucucuugaaccaguucagccgggccguggccgacagcuggauggaggaggucaucaagcucugcggccgcgagcucguccgcgcccagaucgccaucugcggcauguccaccugguccgagcccaaguccuccgacaagacccacaccucuccuccaagcccugcgcccgagcuccucggcggcuccuccgucuuccucuucccaccaaagcccaaggacacccucuacaucacccgcgagcccgaggucaccugcgucgucgucgacgucucccacgaggacccagaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccucccagccccaaucgagaagaccaucuccaaggccaagggccaaccuagagaaccacaggucuacacacucccuccuagccgcgacgagcucaccaagaaccaggugucccucaccugccucgucaagggcuucuacccauccgauaucgccgucgagugggaguccaacggacagccggagaacaacuacaagaccacaccucccguccucgacuccgacggcuccuucuuccuguacuccaagcugaccguggacaagucccgcuggcagcagggcaacgucuucuccugcuccgucaugcacgaggcccugcacaaccacuacacccagaagucccucucccugagccccggcaagcgcaagaagagaagucuuagccaggaggacgccccccagaccccuagaccggucgccgagaucguccccuccuucaucaacaaggauacagagacgaucaacaugauguccgaguucgucgccaaccugccacaggagcugaagcugacacucuccgagaugcagcccgcccugccucagcuccagcagcacgugccagugcugaaggacuccucauuacucuucgaggaguucaagaagcucauccgcaaccgccaguccgaggccgccgacucuagcccuuccgagcucaaguaccucggccucgacacccacucccggaagaagcggcagcuguacagcgcccucgccaacaagugcugccacgucggcugcaccaagcggucccuugcccgcuucugc

SEQ ID NO: 427 - RNA, 1257 nt, Artificial Sequence
  Synthetic Polynucleotide
augccccggcuauucuucuuccacuuacucggcgugugccuccucuugaaccaguucagccgggccguggccgacagcuggauggaggaggugaucaagcuuugcggccgggagcuugugcgggcccagaucgccaucugcggcaugagcaccuggagcgagcccaagagcagcgacaagacccacaccagcccuccuuccccugcccccgaguugcugggaggcagcagcguguuccuguucccaccgaagcccaaggacacccuguacaucacccgggagcccgaggugaccugcguggugguggacgugagccacgaggacccagaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccagccccuaucgagaagaccaucagcaaggccaagggccagccuagggagccacagguguacacccugccaccuagccgggacgagcugaccaagaaccaggugagccugaccugccuggugaagggcuucuaccccagcgacaucgccguggagugggagagcaacggccagccggagaacaacuacaagaccaccccacccgugcuggacagcgacggcagcuucuuccuguacagcaagcugacgguggacaagagccgguggcagcagggcaacguguucagcugcagcgugaugcacgaggcucugcacaaccacuacacccagaagaguuuaagcuugucacccggcaagcggaagaagcggucccugagccaggaggacgccccucagacccccagaccuguugccgagaucgugcccagcuucaucaauaaggauaccgaaaccaucaacaugaugagcgaguucguggccaaccugccccaggagcugaagcugacccugagcgagaugcagcccgcccugccucaguugcagcagcacgugccugugcugaaggacagcagccugcuguucgaggaguucaagaagcugauccggaaccggcagagcgaggccgccgacuccuccccuagcgagcucaaguaccugggccuggacacccacagcagaaagaagagacagcucuacagcgcccuggccaacaagugcugccacguggguugcaccaagcgcagccuggcccgguucugc

SEQ ID NO: 428 - RNA, 1257 nt, Artificial Sequence
  Synthetic Polynucleotide
augccccgguuauucuucuuccaccuccucggcgugugccucuugcucaaccaguucagccgggccguggccgacagcuggauggaggaggugaucaagcucugcggccgggaguuggugcgggcccagaucgccaucugcggcaugagcaccuggagcgagcccaagagcagcgacaagacccacaccuccccuccuagcccggcgcccgagcugcugggaggcagcagcguguuccuguucccuccuaagcccaaggacacccuguacaucacccgggagcccgaggugaccugcguggugguggacgugagccacgaggacccagaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugccccuaucgagaagaccaucagcaaggccaagggccagccacgcgagccucagguguacacccugccaccuagccgggacgagcugaccaagaaccaggugagccugaccugccuggugaagggcuucuaccccagcgacaucgccguggagugggagagcaacggccagccugagaacaacuacaagaccaccccucccgugcuggacagcgacggcagcuucuuccuguacagcaagcugacgguggacaagagccgguggcagcagggcaacguguucagcugcagcgugaugcacgaggcucugcacaaccacuacacccagaagucacugagccugucacccggcaagcggaagaagagaagccugucccaggaggacgcaccucagaccccccggccuguggccgagaucgugcccagcuucaucaauaaggauaccgaaaccaucaacaugaugagcgaguucguggccaaccugccccaggagcugaagcugacccugagcgagaugcagcccgcucugccucagcuucagcagcacgugccuguccugaaggacagcagccugcuguucgaggaguucaagaagcugauccggaaccggcagagcgaggccgccgacucuagcccuagcgaacucaaguaccugggccuggacacccacagcagaaagaagcgccagcucuacagcgcccuggccaacaagugcugccacgugggaugcaccaagcgaagccuggcccgguucugc

SEQ ID NO: 429 - RNA, 1257 nt, Artificial Sequence
  Synthetic Polynucleotide
augcccagacucuucuucuuccaccuuuugggcgugugccuccuccucaaccaguucagccgggccguggccgacagcuggauggaggaggucaucaagcucugcggccgcgagcucguccgcgcccagaucgccaucugcggcauguccaccugguccgagcccaaguccuccgacaagacccacaccuccccgccuagcccugcccccgagcuccucggcggcuccuccgucuuccucuucccuccaaagcccaaggacacccucuacaucacccgcgagcccgaggucaccugcgucgucgucgacgucucccacgaggacccggaggugaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguauccaacaaggcccugccugcuccuaucgagaagaccaucuccaaggccaagggccaaccuagagagccacaggucuacacccugccuccgucccgcgacgagcucaccaagaaccaggugucccucaccugccucgucaagggcuucuacccuagcgacaucgccgucgagugggaguccaacggccagccugagaacaacuacaagaccaccccucccguccucgacuccgacggcuccuucuuccuuuacuccaagcugaccgucgacaagucccgcuggcagcagggcaacgucuucuccugcuccgucaugcacgaggcccuccacaaccacuacacccagaagucccucucgcucucccccggcaagcgcaagaagagaucccugucgcaggaggacgccccccagaccccuagaccggucgccgagaucguccccuccuucaucaauaaggacacagaaaccaucaacaugauguccgaguucgucgccaacuugccacaggagcugaagcucacccucuccgagaugcagcccgcccucccacagcuccagcagcacgugccuguccucaaggacuccucccuccucuucgaggaguucaagaagcucauccgcaaccgccaguccgaggccgccgauagcucaccuuccgagcucaaguaccucggccucgacacccacuccagaaagaagcggcagcuguacuccgcccucgccaacaagugcugccacgucggcugcaccaagagaagccucgcccgcuucugc

SEQ ID NO: 430 - RNA, 1257 nt, Artificial Sequence
  Synthetic Polynucleotide
augccccgacuguucuucuuccacuugcuuggcgugugccuccucuuaaaccaguucagccgggccguggccgacagcuggauggaggaggucaucaagcucugcggccgcgagcucguccgcgcccagaucgccaucugcggcauguccaccugguccgagcccaaguccuccgacaagacccacaccucuccgccaagcccagcucccgagcuccucggcggcuccuccgucuuccucuucccuccuaagcccaaggacacccucuacaucacccgcgagcccgaggucaccugcgucgucgucgacgucucccacgaggacccagaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccugccugccccuaucgagaagaccaucuccaaggccaagggccagccuagagagccucaggucuacacccugccaccuucgcgcgacgagcucaccaagaaccaggugucccucaccugccucgucaagggcuucuacccauccgacaucgccgucgagugggaguccaacggccaaccugagaacaacuacaagaccaccccacccguccucgacuccgacggcuccuucuuccuguacuccaagcugaccguggacaagucccgcuggcagcagggcaacgucuucuccugcuccgucaugcacgaagcccugcacaaccacuacacccagaagucccucagcuugucccccggcaagcgcaagaagcggucccugucccaggaggacgccccccagaccccuagaccugucgccgagaucguccccuccuucaucaauaaggauaccgagacuaucaacaugauguccgaguucgucgccaaccucccacaggagcugaagcucacccucuccgagaugcagcccgcucugccacagcuccagcagcacgucccugugcucaaggacuccucccuccucuucgaggaguucaagaagcucauccgcaaccgccaguccgaggccgccgacuccagcccuagcgagcucaaguaccucggccucgacacccacuccaggaagaagagacagcucuacagcgcccucgccaacaagugcugccacgucggcugcaccaagagaagccuggcccgcuucugc

SEQ ID NO: 431 - RNA, 1257 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcggccgggagcuggugcgggcccagaucgccaucugcggcaugagcaccuggagcgagcccaagagcagcgacaagacccacaccagcccccccagccccgcccccgagcugcugggcggcagcagcguguuccuguucccccccaagcccaaggacacccuguacaucacccgggagcccgaggugaccugcguggugguggacgugagccacgaggaccccgaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugcccgcccccaucgagaagaccaucagcaaggccaagggccagccccgggagccccagguguacacccugccccccagccgggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagccgguggcagcagggcaacguguucagcugcagcgugaugcacgaggcccugcacaaccacuacacccagaagagccugagccugagccccggcaagcggaagaagcggagccugagccaggaggacgccccccagaccccccggcccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugauccggaaccggcagagcgaggccgccgacagcagccccagcgagcugaaguaccugggccuggacacccacagccggaagaagcggcagcuguacagcgcccuggccaacaagugcugccacgugggcugcaccaagcggagccuggcccgguucugc

SEQ ID NO: 432 - RNA, 1257 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcgggagggagcuggugagggcgcagaucgcgaucugcgggaugagcacguggagcgagccgaagagcagcgacaagacgcacacgagcccgccgagcccggcgccggagcugcugggggggagcagcguguuccuguucccgccgaagccgaaggacacgcuguacaucacgagggagccggaggugacgugcguggugguggacgugagccacgaggacccggaggugaaguucaacugguacguggacgggguggaggugcacaacgcgaagacgaagccgagggaggagcaguacaacagcacguacaggguggugagcgugcugacggugcugcaccaggacuggcugaacgggaaggaguacaagugcaaggugagcaacaaggcgcugccggcgccgaucgagaagacgaucagcaaggcgaaggggcagccgagggagccgcagguguacacgcugccgccgagcagggacgagcugacgaagaaccaggugagccugacgugccuggugaagggguucuacccgagcgacaucgcgguggagugggagagcaacgggcagccggagaacaacuacaagacgacgccgccggugcuggacagcgacgggagcuucuuccuguacagcaagcugacgguggacaagagcagguggcagcaggggaacguguucagcugcagcgugaugcacgaggcgcugcacaaccacuacacgcagaagagccugagccugagcccggggaagaggaagaagaggagccugagccaggaggacgcgccgcagacgccgaggccgguggcggagaucgugccgagcuucaucaacaaggacacggagacgaucaacaugaugagcgaguucguggcgaaccugccgcaggagcugaagcugacgcugagcgagaugcagccggcgcugccgcagcugcagcagcacgugccggugcugaaggacagcagccugcuguucgaggaguucaagaagcugaucaggaacaggcagagcgaggcggcggacagcagcccgagcgagcugaaguaccuggggcuggacacgcacagcaggaagaagaggcagcuguacagcgcgcuggcgaacaagugcugccacguggggugcacgaagaggagccuggcgagguucugc

SEQ ID NO: 433 - RNA, 1257 nt, Artificial Sequence
  Synthetic Polynucleotide
augccccggcuguucuucuuccaccugcugggcgugugccugcugcugaaccaguucagccgggccguggccgacagcuggauggaggaggucaucaagcucugcggccgcgagcucguccgcgcccagaucgccaucugcggcauguccaccugguccgagcccaaguccuccgacaagacccacaccuccccccccucccccgcccccgagcuccucggcggcuccuccgucuuccucuucccccccaagcccaaggacacccucuacaucacccgcgagcccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagcgcaagaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugc

SEQ ID NO: 434 - RNA, 1257 nt, Artificial Sequence
  Synthetic Polynucleotide
augccccgccuguucuucuuccaccuccucggcgucugccuccuccucaaccaguucucccgcgccguggcggacagcuggauggaggaggugaucaagcucugcggccgcgagcucgugcgcgcccagaucgccauuugcggcauggagcccaagagcuccgacaagacccacaccagcccgcccagccccgccccugagcugcugggcggauccagcgucuuccuguuuccccccaagcccaaggacacccuguacaucacaagggagcccgaggucaccugcguggugguggacgucagccacgaggaccccgaggugaaauuuaacugguacguagacggcguggaggugcacaacgccaagaccaagcccagggaggagcaguacaacagcaccuaccgggugguaagcguccugaccgugcugcaccaggacuggcugaacggcaaggaguauaagugcaaagugagcaacaaggcccugcccgcccccaucgagaagaccaucagcaaggccaaggggcagccccgggagccacagguguacacccugccccccagcagggacgagcugaccaagaaccaggugagucucacaugccugguuaagggcuucuacccauccgacaucgccguggagugggaaagcaacggucagcccgagaacaacuacaagaccacgcccccggugcuggacuccgacggcagcuucuuccuguacuccaagcucaccguggacaaguccagguggcagcaggggaacguguucagcugcagcgugaugcaugaggcacugcacaaccacuacacgcagaagucccugucucugagcccaggcaagcgcaagagcaccuggagcaagaggucccugagccaagaggacgccccccagaccccccggccuguggccgagaucgugcccagcuucaucaacaaggacaccgagacgaucaacaugaugagcgaauuuguggccaaucugccccaggagcugaagcucacccucuccgaaaugcagcccgcccucccccaacugcaacaacacguccccgugcugaaggacagcagccugcuguuugaggaauuuaagaagcucaucagaaacagacagagcgaggccgcggacuccagccccagcgagcugaaguaccugggccuggacacccauagcaggaagaagcggcagcuguacagcgcccucgccaacaagugcugccacgugggcugcaccaagagaagccuggccagguucugc

SEQ ID NO: 435 - RNA, 1257 nt, Artificial Sequence
  Synthetic Polynucleotide
augccccgacucuucuucuuccaccuccucggcgugugccuccuccucaaccaguucucucgagccguggccgauuccuggauggaggaggugaucaagcucugcggcagagaacucgugagagcccagaucgccauuugugggauggagcccaagagcagcgacaagacccauacuagcccacccucccccgcccccgagcugcuggggggcagcagcguguuccuguuucccccgaagcccaaggacacccuguacaucacccgggagcccgaggugaccugcgugguugucgacgugucacacgaagaccccgaggugaaguucaacugguacguggacggcgucgaggugcacaacgccaagaccaagcccagggaggagcaguacaacagcacguacagaguggugucaguccugaccguccuccaccaggauuggcucaacggcaaagaguacaagugcaaggugagcaacaaggcccugcccgcccccaucgagaagacaaucuccaaggccaagggccagccgagggagccccagguguauacccugccccccucaagggacgagcugaccaagaaucaggugucccucacaugccuggugaagggguucuaccccagcgacaucgccguggagugggagagcaacggacagcccgagaacaacuacaagaccacaccccccgugcuggacagcgauggaaguuucuuccuguauagcaaacugaccguggacaaaucacgguggcagcagggcaacguguucagcugcagcgugaugcacgaagcccugcacaaccacuacacccagaagucauuaucucugagccccggcaagagaaagagcacguggagcaagaggagccucucccaggaggacgccccccagaccccccggcccguggccgagaucgugcccuccuuuauuaacaaggacaccgagacaaucaacaugauguccgaguucgucgccaaucugccccaggagcucaagcucacccugagcgagaugcagcccgcucugccccagcugcagcaacacgugcccgugcugaaggacagcagccugcuguucgaggaguucaagaagcugauccgcaaccggcaaagcgaggccgcugacagcucgcccagcgagcugaaguaccuggggcuggacacccacagccggaagaagcggcagcuguacagcgcccuggccaacaagugcugccacguggggugcacuaagcggagccuggccagauuuugc

SEQ ID NO: 436 - RNA, 1257 nt, Artificial Sequence
  Synthetic Polynucleotide
augcccagacuguucuucuuucaccuccucggcgugugucuuuuacucaaccaauuuagcagagccguggccgacucuuggauggaggaggugaucaagcucuguggccgcgagcuuguccgggcccagaucgcuaucugcggaauggagcccaaguccuccgacaagacccacaccuccccacccagucccgcccccgagcugcucgggggcagcagcguguuccuguucccuccuaagcccaaggacacgcuguacaucaccagggagcccgaggucaccugcguggugguggacgugucccaugaggaccccgaggugaaguucaacugguacguggacggcguggagguucacaacgcuaagaccaagccccgcgaggaacaguacaacagcaccuaucgggucgugucaguucugaccguccuccaccaggacuggcugaacggcaaggaguacaagugcaaggugagcaacaaagcccuccccgccccgaucgagaagaccaucagcaaggccaagggccagccccgagagccccagguguacacccuuccccccagcagggacgagcucacaaagaaucaggugagccugaccugccuggugaagggcuucuaccccuccgacaucgcgguggaaugggagagcaacggccagccggagaacaacuauaagacaacaccccccgugcuggacagcgacggcagcuucuuccucuacagcaagcugaccgucgacaaguccagauggcagcagggcaacguguucagcugcuccgugaugcacgaagcccugcacaaucacuacacucagaaaucccugucccugagccccggcaagcggaaguccaccuggaguaagcggagucugagccaggaggacgccccccaaaccccccgacccguggccgagaucgugcccuccuucaucaauaaggacaccgagacuaucaacaugaugagcgaguucguggccaaccugccccaggagcugaagcugacgcugucugagaugcagccugcccugccccagcugcagcagcacgugccagugcugaaggacagcagccugcuguucgaggaguuuaagaagcuaaucagaaaccgccaguccgaggccgccgacagcagccccuccgagcucaaguaccugggccuggacacccauucccgcaagaagaggcagcuguacucggcccuggccaacaagugcugucacgucggauguaccaagagaagucuggccagguucugc

SEQ ID NO: 437 - RNA, 1257 nt, Artificial Sequence
  Synthetic Polynucleotide
augccgcggcuuuucuucuuccaccuccucggcgugugccuacuccuuaaccaauucucccgagccgucgccgacagcuggauggaggaggugaucaaacucugcggcagggagcucgugagggcccagauagccaucugcggcauggaacccaaguccagcgacaagacccacaccagcccgcccagccccgcccccgagcugcugggcggcucaagcguguuccuguucccgcccaagcccaaggacacccuguacaucaccagagagccggaggucaccugcguggugguggacgugucucacgaggaccccgaagucaaguucaacugguacguggauggcguggaggugcacaaugcaaagaccaagccgagagaggaacaguacaacucgacguaccgggucgugagcguccugaccgugcugcaccaggacuggcugaauggcaaggaguacaagugcaaagugucgaauaaggcccugcccgcccccaucgagaagaccaucuccaaggccaagggccagcccagagaaccgcagguauacacccugcccccuucccgggacgagcugaccaagaaccaggugucucucacgugccuggugaagggcuucuaccccagcgacaucgccguggagugggaguccaauggucagcccgagaacaacuauaagaccacgccgcccgugcuggacucagacggcuccuucuuccucuacagcaaacugacgguggacaagagccgguggcagcagggcaacguguucuccugcagcgucaugcacgaggcccugcacaaccacuacacucagaagucccugagccugagccccgggaagcgaaagucuaccuggagcaagcggagccugagccaagaggacgccccccaaacaccccggcccguggccgagauagugccuagcuucauuaacaaggacaccgagacuaucaacaugaugagcgaguucguggcgaaccugccccaggagcugaagcugacccuguccgagaugcagccggcccugccucagcugcagcagcacgugcccgugcugaaggacagcagccugcuguuugaggaguucaagaagcugauccgcaaccgccaaagcgaagccgccgacuccagcccuagcgagcucaaguaccugggccuggacacgcacagcaggaagaagaggcagcuguacagcgcccuggccaacaagugcugccacgucgggugcaccaagaggagccuggcuagguuuugc

SEQ ID NO: 438 - RNA, 1257 nt, Artificial Sequence
  Synthetic Polynucleotide
augccccgccuguucuucuuccaccuccuuggcgugugccuccuccuaaaucaguucagccgcgccguggccgacagcuggauggaggaggugaucaagcucugcgggagggagcucgugcgggcccagaucgccaucugcggcauggagcccaaguccagcgacaagacccacaccucgccccccagccccgcccccgagcugcugggcgggagcagcguuuuccuguuuccaccuaagcccaaggacacucuguacaucaccagagagcccgaggucacaugcguggugguggacgugagccacgaggaccccgaggugaaguucaacugguacgucgauggcgucgaggugcacaacgccaagaccaagcccagggaggagcaguacaacagcaccuacagagugguguccgugcugaccgugcugcaccaggacuggcugaacggaaaggaguacaagugcaaggugagcaacaaggcccugcccgcgccgaucgagaagaccauaagcaaggccaagggccaaccgagggagccccagguguacacccugccccccagcagagacgagcugaccaagaaccaggugagccugaccugccuggucaagggcuucuaccccagcgauaucgccguggaaugggaguccaacggacagccggagaacaacuacaagaccacgccccccgugcucgacagcgacggguccuucuuccuguacucgaagcugaccguggacaagagccgcuggcagcagggcaacguguucagcugcuccgugaugcaugaggcccugcacaaccacuauacgcagaagucgcucagccugagccccggcaagcgaaagagcaccuggagcaagcgaagccuuagccaggaggaugccccccagacaccccggccaguggcugagaucguccccagcuucaucaacaaagacacugagacaauuaauaugaugagcgaguucguggccaaucugccccaggagcucaagcugacccucagcgagaugcagcccgcucugccccagcugcaacagcacguucccgugcugaaggacagcucucugcuguucgaggaguucaagaagcugaucaggaaccgacagagcgaggccgccgacuccagccccucggagcucaaauaccucggccucgacacccacagcaggaagaagaggcagcuguacagcgcccuggccaacaagugcugccacgucggcugcaccaagaggucacucgccagguucugc

SEQ ID NO: 439 - RNA, 1257 nt, Artificial Sequence
  Synthetic Polynucleotide
augcccaggcuguucuucuuccaccuccucggcgugugccuccuccucaaucaguucagcagagccguggccgauagcuggauggaggaggucauuaagcucugcggcagagagcucgugcgagcccagaucgccaucugcggcauggagcccaagagcagcgauaagacccauaccucuccucccagccccgcccccgagcugcugggcggcuccuccguguuccuguucccucccaagcccaaagacacccuguacaucaccagagaacccgaggugaccugugucgugguggacgugagccacgaggacccggaggugaaguucaauugguacguggauggugucgaggugcacaacgccaagacgaagcccagggaggagcaguauaacagcacuuaucgcguggucagcgugcugaccguccugcaccaagacuggcugaacgguaaggaguauaagugcaaggucagcaacaaagcccugcccgcucccaucgagaagacgaucagcaaggccaagggccagcccagggagccccagguguacacucugccccccagcagagacgagcugaccaagaaucaggugagccugaccugccuggugaagggguucuaccccagcgacaucgccgucgagugggagagcaacggccagcccgagaacaacuauaagaccacacccccggugcuggacuccgacggaagcuucuuccuguacuccaagcucacaguugacaagagcagauggcagcagggcaauguguucagcugcagcgugaugcacgaggcccuccacaaccacuacacccagaaaucccucagccugagccccggcaagaggaagucgaccuggagcaagaggagccugucccaggaggacgccccccaaacgccccggccgguggccgagaucguccccagcuucaucaacaaggacaccgagacuauaaacaugaugagcgaguucguggccaaccugccccaggagcucaagcugacccugagcgagaugcagcccgcacugccccaacugcagcagcacgugcccgugcugaaggacagcagccuccuguucgaggaguucaagaagcugaucaggaacaggcagagcgaggccgccgacagcagccccagcgagcugaaguaccugggacuggacacccacagccggaagaagcgccagcucuacagcgcccuggccaacaagugcugccauguggggugcaccaagcggucccuggcccgguucugc

SEQ ID NO: 440 - RNA, 1257 nt, Artificial Sequence
  Synthetic Polynucleotide
augccccgacuguucuucuuccaccuccucggcgugugucucuugcuuaaucaguucagccgcgccgucgccgacuccuggauggaggaagugaucaagcucuguggccgggagcucgugcgggcucagauugcaaucugcgggauggagcccaagucguccgacaagacccacaccagcccgcccucgcccgcccccgagcugcuuggcggcagcagcguguuccuguuuccccccaagcccaaggacacccuguacaucacccgggaacccgaggugaccugcgucgugguggacgugucccacgaggaccccgaggucaaguucaacugguacguggacggcguggaggugcacaaugccaagaccaagcccagggaggagcaauacaacuccaccuaucggguggugagcgugcugaccgugcugcaccaggacuggcugaacggcaaggaguacaagugcaaggugucaaacaaggcgcugcccgcccccaucgagaagacaaucuccaaggccaagggccagccccgggagccccagguguacacccugccccccagccgggacgagcugaccaagaaccagguuagccuuacaugccuggucaagggcuucuaccccuccgacaucgccguggagugggaguccaacggccagcccgagaacaacuacaagaccacaccccccgugcuggacuccgacggcuccuucuuccuuuacucuaagcugaccguggacaagagccgcuggcaacagggcaaugucuucuccugcuccgugaugcacgaggcccugcacaaucacuacacccagaagucccugagccuguccccuggaaagcggaaguccaccuggagcaagaggagccugucccaggaggaugccccucagacccccaggcccguggccgagaucgugccuucauuuauuaacaaggacaccgagacgaucaacaugauguccgaguuuguggccaaccugccccaggagcugaagcucacccucagcgaaaugcagcccgcccugccccagcugcagcagcacgugcccgugcugaaggacuccucgcugcucuuugaggaguuuaagaagcugauccggaacaggcagagcgaggccgcagauuccagccccucggagcugaaguaccugggccuggacacccacagccggaagaagcgucagcuguacagcgcccuggccaacaaauguugucacgugggcugcacuaagaggagccuggccagauuuugu

SEQ ID NO: 441 - RNA, 1257 nt, Artificial Sequence
  Synthetic Polynucleotide
augccccgguuauucuucuuccacuugcuuggcgugugccuccuccucaaccaguucagccgggccguggccgacagcuggauggaggaggugaucaagcuaugcggccgggagcucgugcgggcccagaucgccaucugcggcauggagcccaagagcagcgacaagacccacaccuccccaccauccccugcccccgagcugcugggaggcagcagcguguuccuguucccaccuaagcccaaggacacccuguacaucacccgggagcccgaggugaccugcguggugguggacgugagccacgaggacccugaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugccccuaucgagaagaccaucagcaaggccaagggccagccucgggagccacagguguacacccugccuccuucccgggacgagcugaccaagaaccaggugagccugaccugccuggugaagggcuucuaccccagcgacaucgccguggagugggagagcaacggucagccugagaacaacuacaagaccacuccacccgugcuggacagcgacggcagcuucuuccuguacagcaagcuuaccgucgacaagagccgguggcagcagggcaacguguucagcugcagcgugaugcacgaagcccugcacaaccacuacacccagaagagucugucacugagccccggcaagaggaaguccaccuggucaaagcggagccugagccaggaggacgcuccucaaaccccccggccaguggccgagaucgugcccagcuucaucaauaaggacacagagacaaucaacaugaugagcgaguucguggccaaccugccccaggagcugaagcugacgcucagcgagaugcagcccgcccucccucaacuacagcagcacgugccggugcugaaggacagcagccugcuguucgaggaguucaagaagcugauccggaaccggcagagcgaggccgcugacagcuccccuuccgagcuuaaguaccugggccuggacacccacagccggaagaagaggcagcuguacagugcccuggccaacaagugcugccacgugggcugcacuaagaggucacuggcccgguucugc

SEQ ID NO: 442 - RNA, 1257 nt, Artificial Sequence
  Synthetic Polynucleotide
augccccggcuuuucuucuuccacuuacucggcgugugccuucuccuuaaccaguucagccgggccguggccgacagcuggauggaggaggugaucaagcucugcggccgggagcucgugcgggcccagaucgccaucugcggcauggagcccaagagcagcgacaagacccacaccagcccuccuaguccugcgcccgagcugcuuggcggcagcagcguguuccuguucccaccgaagcccaaggacacccuguacaucacccgggagcccgaggugaccugcguggugguggacgugagccacgaggacccggaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugccccaaucgagaagaccaucagcaaggccaagggccaaccacgagagccgcagguguacacccugccuccuagccgggacgagcugaccaagaaccaggugagccugaccugccuggugaagggcuucuaccccagcgacaucgccguggagugggagagcaacggucagccugagaacaacuacaagaccacaccucccgugcuggacagcgacggcagcuucuuccuguacagcaagcugacaguugacaagagccgguggcagcagggcaacguguucagcugcagcgugaugcacgaggcccugcacaaccacuacacccagaagagucugucucuguccccuggcaagaggaaguccaccugguccaagaggucccugagccaggaggacgccccgcagaccccccggccuguggcugagaucgugcccagcuucaucaauaaggauaccgagacaaucaacaugaugagcgaguucguggccaauuugccacaggagcugaagcugacgcugagcgagaugcagcccgcccugccgcagcuccagcaacacgugccuguccugaaggacagcagccugcuguucgaggaguucaagaagcugauccggaaccggcagagcgaggccgccgacucuucuccguccgaacugaaguaccugggccuggacacccacagccggaagaagcggcagcucuacuccgcccuggccaacaagugcugccacgugggaugcaccaagcgaagccuggcccgguucugc

SEQ ID NO: 443 - RNA, 1257 nt, Artificial Sequence
  Synthetic Polynucleotide
augccccgguuauucuucuuccacuuauuaggcgugugcuuacuccucaaccaguucagccgggccguggccgacagcuggauggaggaggugaucaagcucugcggccgggaguuggugcgggcccagaucgccaucugcggcauggagcccaagagcagcgacaagacccacaccagcccuccuagcccugcccccgagcugcugggaggcagcagcguguuccuguucccuccgaagcccaaggacacccuguacaucacccgggagcccgaggugaccugcguggugguggacgugagccacgaggacccugaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccagcuccuaucgagaagaccaucagcaaggccaagggccagccuagagagccucagguguacacccugccgccaagccgggacgagcugaccaagaaccaggugagccugaccugccuggugaagggcuucuaccccagcgacaucgccguggagugggagagcaacggacagccugagaacaacuacaagaccaccccacccgugcuggacagcgacggcagcuucuuccuguacagcaagcucaccguggacaagagccgguggcagcagggcaacguguucagcugcagcgugaugcacgaagcccugcacaaccacuacacccagaagucccuaucucugagccccggcaagagaaaguccaccuggagcaagagaagucugagccaggaggacgcuccacagaccccccggccaguggccgagaucgugcccagcuucaucaacaaggauacagaaaccauuaacaugaugagcgaguucguggccaaccugccccaggagcugaagcugacacugagcgagaugcagcccgcucugccucagcuucagcagcacgugccugugcugaaggacagcagccugcuguucgaggaguucaagaagcugauccggaaccggcagagcgaggccgccgauagcagcccuagugaacucaaguaccugggccuggacacccacagccggaagaagcggcagcuguauagcgcccuggccaacaagugcugccacgugggcugcacaaagcguagccuggcccgguucugc

SEQ ID NO: 444 - RNA, 1257 nt, Artificial Sequence
  Synthetic Polynucleotide
augccccggcuuuucuucuuccaccuccuuggcgugugccuccuccuuaaccaguucagccgggccguggccgacagcuggauggaggaggucaucaagcucugcggccgcgagcucguccgcgcccagaucgccaucugcggcauggagcccaaguccuccgacaagacccacaccagcccgccaagcccagcccccgagcuccucggcggcuccuccgucuuccucuucccuccaaagcccaaggacacccucuacaucacccgcgagcccgaggucaccugcgucgucgucgacgucucccacgaggacccagagguuaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccugccugccccaaucgagaagaccaucuccaaggccaagggccagccucgggagccucaggucuacacccugccaccuagucgcgacgagcucaccaagaaccaggugucccucaccugccucgucaagggcuucuacccuagcgacaucgccgucgagugggaguccaacggccagccagagaacaacuacaagaccaccccucccguccucgacuccgacggcuccuucuuccuguacuccaagcucacuguggacaagucccgcuggcagcagggcaacgucuucuccugcuccgucaugcacgaagcucuccacaaccacuacacccagaagucccucucacugagccccggcaagcgcaaguccaccugguccaagcggagccucucgcaggaggacgccccccagacaccacgcccugucgccgagaucguccccuccuucaucaauaaggacacggagacgaucaacaugauguccgaguucgucgccaaccugccacaggagcugaagcugacccucuccgagaugcagcccgcccugccgcagcuccagcagcacgugccagugcugaaggacuccucccuccucuucgaggaguucaagaagcucauccgcaaccgccaguccgaggccgcugacucaagcccuucagagcuuaaguaccucggccucgacacccacucccgcaagaagcgccagcuguacagcgcccucgccaacaagugcugccacgucggcugcacaaagcgaagccuggcccgcuucugc

SEQ ID NO: 445 - RNA, 1257 nt, Artificial Sequence
  Synthetic Polynucleotide
augcccaggcuguucuucuuccaccuccuuggcgugugccucuuacucaaccaguucagccgggccguggccgacagcuggauggaggaggucaucaagcucugcggccgcgagcucguccgcgcccagaucgccaucugcggcauggagcccaaguccuccgacaagacccacaccucuccaccgagcccagcccccgagcuccucggcggcuccuccgucuuccucuucccuccuaagcccaaggacacccucuacaucacccgcgagcccgaggucaccugcgucgucgucgacgucucccacgaggacccagaggugaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccugccugccccuaucgagaagaccaucuccaaggccaagggccagccacgggagccacaggucuacacacugccuccgagccgcgacgagcucaccaagaaccaggugucccucaccugccucgucaagggcuucuacccuagcgacaucgccgucgagugggaguccaacggccagccggagaacaacuacaagaccaccccgcccguccucgacuccgacggcuccuucuuccuguacuccaagcugacaguggacaagucccgcuggcagcagggcaacgucuucuccugcuccgucaugcacgaggcucugcacaaccacuacacccagaagucccucagccugucucccggcaagcgcaaguccaccugguccaagaggagcuugucccaggaggacgccccccagacuccacgcccugucgccgagaucguccccuccuucaucaauaaggacacagagacgaucaacaugauguccgaguucgucgccaaccuuccucaggagcugaagcugacccucuccgagaugcagcccgcccugccgcagcuccagcagcacgugccagugcucaaggacuccucccuccucuucgaggaguucaagaagcucauccgcaaccgccaguccgaggccgccgacaguagcccuuccgagcucaaguaccucggccucgacacccacucccgcaagaagcgccagcuguauucagcccucgccaacaagugcugccacgucggcugcacgaagcggagccuggcccgcuucugc

SEQ ID NO: 446 - RNA, 1257 nt, Artificial Sequence
  Synthetic Polynucleotide
augcccagguuguucuucuuccaccuuuugggcgugugccuccuucucaaccaguucagccgggccguggccgacagcuggauggaggaggucaucaagcucugcggccgcgagcucguccgcgcccagaucgccaucugcggcauggagcccaaguccuccgacaagacccacaccucuccuccgaguccagcacccgagcuccucggcggcuccuccgucuuccucuucccgccuaagcccaaggacacccucuacaucacccgcgagcccgaggucaccugcgucgucgucgacgucucccacgaggacccagaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccuuccugccccuaucgagaagaccaucuccaaggccaagggccagccacgggagccucaggucuacacccugccuccuagccgcgacgagcucaccaagaaccaggugucccucaccugccucgucaagggcuucuacccuagcgacaucgccgucgagugggaguccaacggucagccugagaacaacuacaagaccaccccacccguccucgacuccgacggcuccuucuuccuuuacuccaagcugaccguggacaagucccgcuggcagcagggcaacgucuucuccugcuccgucaugcacgaggcccugcacaaccacuacacccagaagucccucucucugagccccggcaagcgcaaguccaccugguccaagagaucucucagccaggaggacgccccccagaccccacgcccagucgccgagaucguccccuccuucaucaacaaggauaccgaaaccaucaacaugauguccgaguucgucgccaaccugccacaggagcugaagcucacacucuccgagaugcagcccgcgcucccacagcuccagcagcacgugccugugcugaaggacuccucccuccucuucgaggaguucaagaagcucauccgcaaccgccaguccgaggccgccgacuccaguccuagcgaacugaaguaccucggccucgacacccacucccgcaagaagcgccagcuguacagcgcccucgccaacaagugcugccacgucggcugcacaaagcgcagccuggcccgcuucugc

SEQ ID NO: 447 - RNA, 1257 nt, Artificial Sequence
  Synthetic Polynucleotide
augccccggcuuuucuucuuccaccuacucggcgugugccuucuccuuaaccaguucagccgggccguggccgacagcuggauggaggaggugaucaagcucugcggccgggagcuugugcgggcccagaucgccaucugcggcauggagcccaagagcagcgacaagacccacaccucuccgccgagcccagcucccgagcuccugggcggcagcagcguguuccuguucccaccaaagcccaaggacacccuguacaucacccgggagcccgaggugaccugcguggugguggacgugagccacgaggacccggaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccugccccuaucgagaagaccaucagcaaggccaagggccagccgcgggagccucagguguacacccugccuccuucucgggacgagcugaccaagaaccaggugagccugaccugccuggugaagggcuucuaccccagcgacaucgccguggagugggagagcaacggccagccugagaacaacuacaagaccaccccucccgugcuggacagcgacggcagcuucuuccuguacagcaaguuaaccguggacaagagccgguggcagcagggcaacguguucagcugcagcgugaugcacgaggcacugcacaaccacuacacccagaagagucugagucucagccccggcaagcggaagucaaccuggagcaagcgaagccugucccaggaggacgccccucagaccccccggccuguggcggagaucgugcccagcuucaucaacaaggauaccgagacaauaaacaugaugagcgaguucguggccaaccugccccaggagcugaagcugacucugagcgagaugcagcccgcccugccacaauugcagcagcacgugccugugcugaaggacagcagccugcuguucgaggaguucaagaagcugauccggaaccggcagagcgaggccgccgacaguagcccuagcgaacuuaaguaccugggccuggacacccacagccggaagaagcggcagcuguacuccgcccuggccaacaagugcugccacgugggcuguaccaagaggagccuggcccgguucugc

SEQ ID NO: 448 - RNA, 1257 nt, Artificial Sequence
  Synthetic Polynucleotide
augccccggcuuuucuucuuccacuugcucggcgugugccuacuucucaaccaguucagccgggccguggccgacagcuggauggaggaggugaucaagcucugcggccgggagcucgugcgggcccagaucgccaucugcggcauggagcccaagagcagcgacaagacccacaccucuccuccuagcccugcccccgagcuccugggcggcagcagcguguuccuguucccaccuaagcccaaggacacccuguacaucacccgggagcccgaggugaccugcguggugguggacgugagccacgaggacccagaagugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugccagccccuaucgagaagaccaucagcaaggccaagggacagccaagagagccucagguguacacccugccaccuagccgggacgagcugaccaagaaccaggugagccugaccugccuggugaagggcuucuaccccagcgacaucgccguggagugggagagcaacggccagccugagaacaacuacaagaccaccccacccgugcuggacagcgacggcagcuucuuccuguacagcaagcucacaguggacaagagccgguggcagcagggcaacguguucagcugcagcgugaugcacgaggcccuccacaaccacuacacacagaagucccugagccuuagccccggcaagagaaagagcaccugguccaagagaagucugucccaggaggacgccccucagaccccccggccaguggcugagaucgugcccagcuucaucaacaaggauacagagacuaucaacaugaugagcgaguucguggccaaccugccccaggagcugaagcugacccugagcgagaugcagcccgcccuuccacaacugcagcagcacgugccagugcugaaggacagcagccugcuguucgaggaguucaagaagcugauccggaaccggcagagcgaggccgccgauagcagcccaagcgaacucaaguaccugggccuggacacccacagccggaagaagcggcagcuguacagugcccuggccaacaagugcugccacgugggaugcaccaagcggagccuggcccgguucugc

SEQ ID NO: 449 - RNA, 1257 nt, Artificial Sequence
  Synthetic Polynucleotide
augccccggcuuuucuucuuccaccucuugggcgugugccucuugcucaaccaguucagccgggccguggccgacagcuggauggaggaggucaucaagcucugcggccgcgagcucguccgcgcccagaucgccaucugcggcauggagcccaaguccuccgacaagacccacaccagcccaccuucaccggcccccgagcuccucggcggcuccuccgucuuccucuucccaccuaagcccaaggacacccucuacaucacccgcgagcccgaggucaccugcgucgucgucgacgucucccacgaggacccagaggugaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguuuccaacaaggcccucccagccccaaucgagaagaccaucuccaaggccaagggccagccucgagagccacaggucuacacccugccaccuucccgcgacgagcucaccaagaaccaggugucccucaccugccucgucaagggcuucuacccuuccgacaucgccgucgagugggaguccaacggacaaccagagaacaacuacaagaccaccccgcccguccucgacuccgacggcuccuucuuccuguacuccaagcugaccguggacaagucccgcuggcagcagggcaacgucuucuccugcuccgucaugcacgaggcccugcacaaccacuacacccagaagucccucucacucucccccggcaagcgcaaguccaccugguccaagagaucccugucccaggaggacgccccccagacaccacguccugucgccgagaucguccccuccuucaucaacaaggauacagaaaccaucaacaugauguccgaguucgucgccaaccuuccucaggagcugaagcucacccucuccgagaugcagcccgccuugccacagcuccagcagcacguuccugugcucaaggacuccucccuccucuucgaggaguucaagaagcucauccgcaaccgccaguccgaggccgccgacuccagcccuagcgagcuaaaguaccucggccucgacacccacucccgcaagaagcgccagcucuauuccgcccucgccaacaagugcugccacgucggcugcacaaagagaagccucgcccgcuucugc

SEQ ID NO: 450 - RNA, 1257 nt, Artificial Sequence
  Synthetic Polynucleotide
augcccagacucuucuucuuccaccuucucggcgugugccuccuucucaaccaguucagccgggccguggccgacagcuggauggaggaggucaucaagcucugcggccgcgagcucguccgcgcccagaucgccaucugcggcauggagcccaaguccuccgacaagacccacaccagcccaccuagcccagcccccgagcuccucggcggcuccuccgucuuccucuucccuccgaagcccaaggacacccucuacaucacccgcgagcccgaggucaccugcgucgucgucgacgucucccacgaggacccagaggugaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaagguguccaacaaggcccugccugccccaaucgagaagaccaucuccaaggccaagggccagccuagagagccucaggucuacacccugccuccaagccgcgacgagcucaccaagaaccagguuucccucaccugccucgucaagggcuucuacccuucugacaucgccgucgagugggaguccaacggccagccagagaacaacuacaagaccaccccucccguccucgacuccgacggcuccuucuuccuguacuccaagcugaccguggacaagucccgcuggcagcagggcaacgucuucuccugcuccgucaugcacgaggcccuccacaaccacuacacccagaagucccucucccucucacccggcaagcgcaaguccaccugguccaagcggucccugucccaggaggacgccccccagaccccucggccggucgccgagaucguccccuccuucaucaacaaggauaccgagacgaucaacaugauguccgaguucgucgccaaucucccacaggagcugaagcuuacccucuccgagaugcagcccgcccugccgcagcuccagcagcacgugccuguccucaaggacuccucccuccucuucgaggaguucaagaagcucauccgcaaccgccaguccgaggccgccgauuccucuccuuccgagcucaaguaccucggccucgacacccacucccgcaagaagcgccagcuguauuccgcccucgccaacaagugcugccacgucggcugcacgaagaggagccuggcccgcuucugc

SEQ ID NO: 451 - RNA, 1257 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcggccgggagcuggugcgggcccagaucgccaucugcggcauggagcccaagagcagcgacaagacccacaccagcccccccagccccgcccccgagcugcugggcggcagcagcguguuccuguucccccccaagcccaaggacacccuguacaucacccgggagcccgaggugaccugcguggugguggacgugagccacgaggaccccgaggugaaguucaacugguacguggacggcguggaggugcacaacgccaagaccaagccccgggaggagcaguacaacagcaccuaccggguggugagcgugcugaccgugcugcaccaggacuggcugaacggcaaggaguacaagugcaaggugagcaacaaggcccugcccgcccccaucgagaagaccaucagcaaggccaagggccagccccgggagccccagguguacacccugccccccagccgggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagccgguggcagcagggcaacguguucagcugcagcgugaugcacgaggcccugcacaaccacuacacccagaagagccugagccugagccccggcaagcggaagagcaccuggagcaagcggagccugagccaggaggacgccccccagaccccccggcccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugauccggaaccggcagagcgaggccgccgacagcagccccagcgagcugaaguaccugggccuggacacccacagccggaagaagcggcagcuguacagcgcccuggccaacaagugcugccacgugggcugcaccaagcggagccuggcccgguucugc

SEQ ID NO: 452 - RNA, 1257 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcgggagggagcuggugagggcgcagaucgcgaucugcgggauggagccgaagagcagcgacaagacgcacacgagcccgccgagcccggcgccggagcugcugggggggagcagcguguuccuguucccgccgaagccgaaggacacgcuguacaucacgagggagccggaggugacgugcguggugguggacgugagccacgaggacccggaggugaaguucaacugguacguggacgggguggaggugcacaacgcgaagacgaagccgagggaggagcaguacaacagcacguacaggguggugagcgugcugacggugcugcaccaggacuggcugaacgggaaggaguacaagugcaaggugagcaacaaggcgcugccggcgccgaucgagaagacgaucagcaaggcgaaggggcagccgagggagccgcagguguacacgcugccgccgagcagggacgagcugacgaagaaccaggugagccugacgugccuggugaagggguucuacccgagcgacaucgcgguggagugggagagcaacgggcagccggagaacaacuacaagacgacgccgccggugcuggacagcgacgggagcuucuuccuguacagcaagcugacgguggacaagagcagguggcagcaggggaacguguucagcugcagcgugaugcacgaggcgcugcacaaccacuacacgcagaagagccugagccugagcccggggaagaggaagagcacguggagcaagaggagccugagccaggaggacgcgccgcagacgccgaggccgguggcggagaucgugccgagcuucaucaacaaggacacggagacgaucaacaugaugagcgaguucguggcgaaccugccgcaggagcugaagcugacgcugagcgagaugcagccggcgcugccgcagcugcagcagcacgugccggugcugaaggacagcagccugcuguucgaggaguucaagaagcugaucaggaacaggcagagcgaggcggcggacagcagcccgagcgagcugaaguaccuggggcuggacacgcacagcaggaagaagaggcagcuguacagcgcgcuggcgaacaagugcugccacguggggugcacgaagaggagccuggcgagguucugc

SEQ ID NO: 453 - RNA, 1257 nt, Artificial Sequence
  Synthetic Polynucleotide
augccccggcuguucuucuuccaccugcugggcgugugccugcugcugaaccaguucagccgggccguggccgacagcuggauggaggaggucaucaagcucugcggccgcgagcucguccgcgcccagaucgccaucugcggcauggagcccaaguccuccgacaagacccacaccuccccccccucccccgcccccgagcuccucggcggcuccuccgucuuccucuucccccccaagcccaaggacacccucuacaucacccgcgagcccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagcgcaaguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugc

SEQ ID NO: 454 - RNA, 1233 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcggcagcacagacuccggcucugauaccagcuccggcaacagcggcgauggcaauuccggccaacucuacagugcauuggcuaauaaauguugccauguugguuguaccaaaagaucucuugcuagauuuugcggcagcacagacuccggcucugauaccagcuccggcaacagcggcgauggcaauuccggcggcagcuccggaggaggcucuggcucuagcuccggcucuagcggcagcggcggcuccggcggcagcacagacuccggcucugauaccagcuccggcaacagcggcgauggcaauuccggcggcagcuccggaggaggcucuggcucuagcuccggcucuagcggcagcggcggcuccggcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaag

SEQ ID NO: 455 - RNA, 993 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcggcagcacagacuccggcucugauaccagcuccggcaacagcggcgauggcaauuccggccaacucuacagugcauuggcuaauaaauguugccauguugguuguaccaaaagaucucuugcuagauuuugcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaag

SEQ ID NO: 456 - RNA, 1053 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcggcagcacagacuccggcucugauaccagcuccggcaacagcggcgauggcaauuccggccaacucuacagugcauuggcuaauaaauguugccauguugguuguaccaaaagaucucuugcuagauuuugcggcagcacagacuccggcucugauaccagcuccggcaacagcggcgauggcaauuccggcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaag

SEQ ID NO: 457 - RNA, 1317 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcggcagcacagacuccggcucugauaccagcuccggcaacagcggcgauggcaauuccggcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaag

SEQ ID NO: 458 - RNA, 1317 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagagagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacaccaagccccccagcagggacgagcugaccaagaaccaggugagccuguccugccuggugaagggcuucuaccccagcgacaucgccguggagugggagagcaacggccagcccgagaacaacuacaagaccaccguccccgugcuggacagcgacggcagcuuccgccuggccagcuaucugaccguggacaagagcagguggcagcagggcaacguguucagcugcagcgugaugcacgaggcccugcacaaccacuacacccagaagagccugagccugagccccggcaagaggaagggcagcacagacuccggcucugauaccagcuccggcaacagcggcgauggcaauuccggccaacucuacagugcauuggcuaauaaauguugccauguugguuguaccaaaagaucucuugcuagauuuugc

SEQ ID NO: 459 - RNA, 978 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagagaggugcagcugcuggagagcggcggcggccuggugcagcccggcggcagccugaggcugagcugcgccgccagcggcuucaccuucagcagcuacgccaugagcugggugaggcaggcccccggcaagggccuggagugggugagcgccaucagcggcagcggcggcagcaccuacuacgccgacagcgugaagggcagguucaccaucagcagggacaacagcaagaacacccuguaccugcagaugaacagccugagggccgaggacaccgccguguacuacugcaccaaggacccccccagguaccacuacaccggccuggccgugaggggccagggcaccaccgugaccgugagcagcggcagcacagacuccggcucugauaccagcuccggcaacagcggcgauggcaauuccggccaacucuacagugcauuggcuaauaaauguugccauguugguuguaccaaaagaucucuugcuagauuuugc

SEQ ID NO: 460 - RNA, 1317 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagagagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacacccugccccccagcagggacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagguggcagcagggcaacguguucagcugcagcgugaugcacgaggcccugcacaaccacuacacccagaagagccugagccugagccccggcaagaggaagggcagcacagacuccggcucugauaccagcuccggcaacagcggcgauggcaauuccggccaacucuacagugcauuggcuaauaaauguugccauguugguuguaccaaaagaucucuugcuagauuuugc

SEQ ID NO: 461 - RNA, 1317 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcggcagcacagacuccggcucugauaccagcuccggcaacagcggcgauggcaauuccggcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacaccaagccccccagcagggacgagcugaccaagaaccaggugagccuguccugccuggugaagggcuucuaccccagcgacaucgccguggagugggagagcaacggccagcccgagaacaacuacaagaccaccguccccgugcuggacagcgacggcagcuuccgccuggccagcuaucugaccguggacaagagcagguggcagcagggcaacguguucagcugcagcgugaugcacgaggcccugcacaaccacuacacccagaagagccugagccugagccccggcaagaggaag

SEQ ID NO: 462 - RNA, 978 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcggcagcacagacuccggcucugauaccagcuccggcaacagcggcgauggcaauuccggcgaggugcagcugcuggagagcggcggcggccuggugcagcccggcggcagccugaggcugagcugcgccgccagcggcuucaccuucagcagcuacgccaugagcugggugaggcaggcccccggcaagggccuggagugggugagcgccaucagcggcagcggcggcagcaccuacuacgccgacagcgugaagggcagguucaccaucagcagggacaacagcaagaacacccuguaccugcagaugaacagccugagggccgaggacaccgccguguacuacugcaccaaggacccccccagguaccacuacaccggccuggccgugaggggccagggcaccaccgugaccgugagcagc

SEQ ID NO: 463 - RNA, 1317 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcggcagcacagacuccggcucugauaccagcuccggcaacagcggcgauggcaauuccggcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacaccaagccccccagcagggacgagcugaccaagaaccaggugagccuguccugccuggugaagggcuucuaccccagcgacaucgccguggagugggagagcaacggccagcccgagaacaacuacaagaccaccguccccgugcuggacagcgacggcagcuuccgccuggccagcuaucugaccguggacaagagcagguggcagcagggcaacguguucagcugcagcgugaugcacgaggcccugcacaaccacuacacccagaagagccugagccugagccccggcaagaggaagaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugc

SEQ ID NO: 464 - RNA, 714 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcggcagcacagacuccggcucugauaccagcuccggcaacagcggcgauggcaauuccggccaacucuacagugcauuggcuaauaaauguugccauguugguuguaccaaaagaucucuugcuagauuuugcggcagcacagacuccggcucugauaccagcuccggcaacagcggcgauggcaauuccggcgaggugcagcugcuggagagcggcggcggccuggugcagcccggcggcagccugaggcugagcugcgccgccagcggcuucaccuucagcagcuacgccaugagcugggugaggcaggcccccggcaagggccuggagugggugagcgccaucagcggcagcggcggcagcaccuacuacgccgacagcgugaagggcagguucaccaucagcagggacaacagcaagaacacccuguaccugcagaugaacagccugagggccgaggacaccgccguguacuacugcaccaaggacccccccagguaccacuacaccggccuggccgugaggggccagggcaccaccgugaccgugagcagc

SEQ ID NO: 465 - RNA, 1053 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcggcagcacagacuccggcucugauaccagcuccggcaacagcggcgauggcaauuccggccaacucuacagugcauuggcuaauaaauguugccauguugguuguaccaaaagaucucuugcuagauuuugcggcagcacagacuccggcucugauaccagcuccggcaacagcggcgauggcaauuccggcgagcccaagagcagcgacaagacccacaccagcccccccagccccgcccccgagcugcugggcggcagcagcguguuccuguucccccccaagcccaaggacacccuguacaucaccagggagcccgaggugaccugcguggugguggacgugagccacgaggaccccgaggugaaguucaacugguacguggacggcguggaggugcacaacgccaagaccaagcccagggaggagcaguacaacagcaccuacaggguggugagcgugcugaccgugcugcaccaggacuggcugaacggcaaggaguacaagugcaaggugagcaacaaggcccugcccgcccccaucgagaagaccaucagcaaggccaagggccagcccagggagccccagguguacaccaagccccccagcagggacgagcugaccaagaaccaggugagccuguccugccuggugaagggcuucuaccccagcgacaucgccguggagugggagagcaacggccagcccgagaacaacuacaagaccaccguccccgugcuggacagcgacggcagcuuccgccuggccagcuaucugaccguggacaagagcagguggcagcagggcaacguguucagcugcagcgugaugcacgaggcccugcacaaccacuacacccagaagagccugagccugagccccggcaagaggaag

SEQ ID NO: 466 - RNA, 555 nt, Artificial Sequence; identical to SEQ ID NO: 345
  Synthetic Polynucleotide

SEQ ID NO: 467 - RNA, 924 nt, Artificial Sequence
  Synthetic Polynucleotide
augccccgccucuucuucuuccaccuccucggcgugugccuccuacucaaccaguuuagcagggccguggccgauagcuggauggaggaggugaucaagcucugcggcagagagcucgugcgggcccagaucgccaucugcggcaugagcaccuggagcaagaggagccugagccaggaggacgccccacaaaccccgcgccccguggccgagaucgugcccagcuucaucaacaaggacaccgaaaccaucaacaugaugagcgaguuugucgccaaccugccccaggagcucaagcugacccugagcgagaugcagcccgcccugccucagcugcagcagcacgugccagugcugaaagacuccagccugcucuuugaagaguucaagaagcugaucaggaacagacagagcgaggccgcugacagcagccccucagagcugaaguaccuggggcuggauacccauagccgcaagaagcggcagcuguacuccgcccucgccaacaagugcugccacgugggcugcaccaagcggagccucgcccgauucuguggcggcggaggguccggcggcggcggcagcgguggaggcgggagcgacauccagaugacccagagccccagcagccuguccgccagugugggcgauagagucaccaucacgugcagggccuccaggcccaucggcaccaugcugagcugguaccagcagaagcccggcaaggcgcccaagcugcugauccuggccuucagcaggcugcaguccggggugcccagccgguucuccggcuccggcagcggcaccgacuuuacccugaccaucagcagccugcagccugaggacuucgccaccuacuacugcgcccaggccggcacccaccccaccacguucggucagggcacuaagguggagaucaagcgg

SEQ ID NO: 468 - RNA, 924 nt, Artificial Sequence; identical to SEQ ID NO: 467
  Synthetic Polynucleotide

SEQ ID NO: 469 - RNA, 924 nt, Artificial Sequence
  Synthetic Polynucleotide
augccccggcuguucuucuuccaccuacucggcgucugccuccuccuaaaccaguuuucccgcgccguggccgacuccuggauggaggaggugaucaagcucugcggcagagagcucgugagggcccagaucgcgauuugcggcauguccaccuggagcaagaggagccucagccaggaggacgcgccccaaaccccgaggcccguggccgagaucgugccgagcuuuaucaacaaggacaccgaaaccaucaacaugauguccgaguuuguggcuaaucugccccaggagcucaagcucacacuguccgagaugcagcccgcccugccccaacugcagcagcacguccccgugcucaaggacagcagccuccucuucgaggaauucaagaagcucauccgcaaccggcagagcgaggccgccgacagcagccccucagagcugaaguaccugggccucgacacccacagccggaagaagaggcagcuguacuccgcccuggccaacaaaugcugccaugugggcugcacaaagaggagccuggcccgguuuugcggagguggugggagcggcgguggcgguucaggcggcggcgguuccgacauccagaugacccagagccccagcagccuguccgcuuccgugggcgaccgugugaccaucaccugccgcgccagccgacccaucggcaccaugcuguccugguaccagcagaagccggggaaggccccaaagcugcugauucuggccuuuagccggcugcagagcggggugcccagcagauucagcggcucggggagcgggaccgacuuuacgcugaccaucagcucccugcagcccgaggauuucgcaacguacuacugugcccaggccggcacccaccccacuacuuucggccagggcaccaagguggagaucaagcgu

SEQ ID NO: 470 - RNA, 924 nt, Artificial Sequence
  Synthetic Polynucleotide
augcccaggcuguucuucuuccaccuccucggcgugugucuccuccucaaccaguucagcagagccgucgccgauucuuggauggaggaggugaucaaguugugcggccgggagcucgugagggcucagaucgccaucugcggcaugucaaccuggagcaagcggucgcugagccaggaggacgccccucagaccccgaggcccguggccgagaucgugccuagcuucaucaacaaggacaccgagacaaucaacaugaugagcgaguuuguggcgaaucugccccaggagcugaagcucacccucagcgagaugcagcccgcccugccccagcugcagcagcacgugcccgugcugaaggacagcagccugcuguucgaggaguuuaagaagcugauccggaacaggcagagcgaggccgccgacagcagccccucugaacugaaguaucucgggcuggacacccacagccggaagaagcgccagcuguacuccgcccuggccaacaaaugcugccacguggggugcaccaaacggagccuggcccgguucuguggcggcggcggcuccggcggcggugggucuggaggcggcggcucggauauccagaugacccagagccccagcagccuguccgccuccgugggcgacagggugaccaucaccugccgggccucuaggcccaucgggaccaugcucagcugguaccagcagaaaccaggcaaggccccuaagcugcugauccuggcauucagccgccugcagagcggcguccccuccagguucagcggcagcgguagcggaacggacuucacccucaccauuagcucccuccagcccgaggacuucgccaccuacuacugugcacaggccgguacccaccccacgaccuucggccagggcacaaagguggagaucaagcgg

SEQ ID NO: 471 - RNA, 924 nt, Artificial Sequence
  Synthetic Polynucleotide
augccuaggcuguucuucuuccaccuccucggcgugugucuccuccucaaccaguucagccgggccguggccgacuccuggauggaggaggugaucaagcucugcggcagagagcucguccgagcccagauagccaucugcggcaugagcaccuggagcaagaggagccugagucaggaggacgccccucagacaccccggcccguggcugagaucgugcccagcuucauuaacaaagacaccgaaaccaucaacaugauguccgaguucguggccaaucugccacaggagcucaagcugacccugagcgagaugcagcccgcccugccccagcugcagcagcacgugcccgugcugaaggacagcagccugcucuuugaggaguucaagaagcugauccgcaaccgacagagcgaggcugccgauagcagcccuuccgaacucaaauaccugggccuggacacacacagccggaagaagcggcagcuguacagcgcccuggcuaacaaguguugccacguagggugcaccaaacgcagccuggccagauucugcggcggcggcggcuccggcggaggcggaucaggcggcggcggcagcgauauccagaugacucagagccccagcucccugagcgccuccguuggggaccgggugaccaucaccugcagagcgagccgccccaucggcaccaugcucuccugguaccaacagaagccaggcaaggccccgaagcugcugauucucgccuucagcaggcugcaaagcggcgugcccagcagguucuccggcuccggcagcggcacagacuucacccugaccaucagcucccugcagccggaggacuucgccaccuacuauugugcccaggccggcacccaccccaccaccuucggccaaggcacaaagguggaaaucaagagg

SEQ ID NO: 472 - RNA, 924 nt, Artificial Sequence
  Synthetic Polynucleotide
augcccagacucuucuucuuccaucuacucggugugugucuccuccucaaucaguuuagccgggccguugccgacagcuggauggaggaggucaucaagcucugcggcagggagcucgugcgggcccagaucgccaucugcggcaugagcaccuggagcaagagaucccugucgcaggaggacgcgccacagacuccucggcccguggccgagaucgugcccagcuuuaucaacaaggacaccgaaaccaucaacaugaugagcgaguucguggcaaaucugccccaggagcugaagcugacccugagcgagaugcagccugccuugccucagcugcagcagcaugugcccgugcucaaagauagcagccugcuguucgaggaguucaagaaacugauccggaaccggcagagcgaggccgccgacuccagccccucugagcugaaguaccuggggcuggacacgcacucccggaagaagagacagcucuauagcgcccuggccaacaagugcugucaugugggaugcaccaagagaagccucgcccgcuucugcggaggcggaggcagcggcgguggcgguagcggaggcggcggguccgacauacagaugacccagagccccuccucccugagugccuccgucggcgaccgggugaccaucacgugccgcgccagccggcccaucggcacaaugcuguccugguaccagcagaagcccgggaaggcgcccaagcugcugauccuggcguucucccggcugcaguccggcgugcccagcagguucagcggcucaggcuccgguaccgacuucacccugacuauaagcagccugcagccggaggauuuugccaccuacuacugcgcccaggccggcacccacccaaccaccuucggccagggcaccaagguggagaucaagcgg

SEQ ID NO: 473 - RNA, 924 nt, Artificial Sequence
  Synthetic Polynucleotide
augcccaggcuguucuucuuccaccuccucggcgugugccuccuccucaaccaguucagccgggccguggccgacagcuggauggaggaggugaucaagcucugcggccgggagcucgugcgggcccagaucgccaucugcggcaugagcaccuggagcaagcggagccugagccaggaggacgccccgcagacuccgcggccaguggccgagaucgugcccagcuucaucaacaaggacaccgaaaccaucaacaugaugagcgaguucguggccaaccugccccaggagcugaagcugacccugagcgagaugcagcccgcucugccgcagcugcagcagcacgugcccgugcugaaggacagcagccugcuguucgaggaguucaagaagcugauccggaaccggcagagcgaggccgcagauucuucuccuagcgagcucaaguaccugggccuggacacccacagccggaagaagcggcagcuguacagcgcccuggccaacaagugcugccacgugggcugcaccaagaggucacuggcccgguucugcggcggcgguggaucuggcggaggaggcucgggaggcggcggcagcgacauccagaugacccagagcccaagcucccuguccgccagcgugggcgaccgggugaccaucaccugccgggccagccggcccaucggcaccaugcugagcugguaccagcagaagcccggcaaggccccgaagcugcugauccuggccuucucuaggcugcagagcggcgugccgagccgguucucgggcagcggcuccggcaccgacuucacccugacuaucucgagccuccagccggaggacuucgccaccuacuacugcgcccaggccggcacccaccccaccaccuucggccagggcaccaagguggagaucaagcgg

SEQ ID NO: 474 - RNA, 924 nt, Artificial Sequence
  Synthetic Polynucleotide
augcccaggcuguucuucuuccaccuccucggcgugugccuccuccuaaaccaguucagccgggccguggccgacagcuggauggaggaggugaucaagcucugcggccgggagcucgugcgggcccagaucgccaucugcggcaugagcaccuggagcaagcggagccugagccaggaggacgccccucagacgccacggccgguggccgagaucgugcccagcuucaucaacaaggacaccgagacaaucaacaugaugagcgaguucguggccaaccugccccaggagcugaagcugacccugagcgagaugcagcccgcccugccgcagcugcagcagcacgugcccgugcugaaggacagcagccugcuguucgaggaguucaagaagcugauccggaaccggcagagcgaggccgccgacuccagccccagcgaauugaaguaccugggccuggacacccacagccggaagaagcggcagcuguacagcgcccuggccaacaagugcugccacgugggcugcaccaagaggagucuggcccgguucugcggcggaggcggaagcgguggaggcggcucuggcggcgguggcucggacauccagaugacccagagcccguccucccuguccgccagcgugggcgaccgggugaccaucaccugccgggccagccggcccaucggcaccaugcugagcugguaccagcagaagcccggcaaggccccgaagcugcugauccuggccuucagcaggcugcagagcggcgugccgagccgguucagcgguagcggcuccggcaccgacuucacccugacaaucagcucgcugcagccagaggacuucgccaccuacuacugcgcccaggccggcacccaccccaccaccuucggccagggcaccaagguggagaucaagcgg

SEQ ID NO: 475 - RNA, 924 nt, Artificial Sequence
  Synthetic Polynucleotide
augcccagacuguucuucuuccaccucuugggcgugugccuccuccucaaccaguucagccgggccguggccgacagcuggauggaggaggucaucaagcucugcggccgcgagcucguccgcgcccagaucgccaucugcggcauguccaccugguccaagcgcucccucucccaggaggacgcuccgcagaccccgcgccccgucgccgagaucguccccuccuucaucaacaaggacaccgagacgaucaacaugauguccgaguucgucgccaaccucccacaggagcucaagcucacccucuccgagaugcagcccgcccugccgcagcuccagcagcacguccccguccucaaggacuccucccuccucuucgaggaguucaagaagcucauccgcaaccgccaguccgaggccgcggacagcagcccguccgagcugaaguaccucggccucgacacccacucccgcaagaagcgccagcucuacuccgcccucgccaacaagugcugccacgucggcugcaccaagaggagccuggcccgcuucugcggcggaggcggcagcggcggcgguggauccgguggcggcggaagcgacauccagaugacccagagcccgagcagccugagcgccuccgucggcgaccgcgucaccaucaccugccgcgccucccgccccaucggcaccaugcucuccugguaccagcagaagcccggcaaggccccuaagcuccucauccucgccuucucccgccuccaguccggcgugccgagccgguucuccggaagcggcucgggcaccgacuucacccucaccaucuccucacuccagccggaggacuucgccaccuacuacugcgcccaggccggcacccaccccaccaccuucggccagggcaccaaggucgagaucaagcgc

SEQ ID NO: 476 - RNA, 924 nt, Artificial Sequence
  Synthetic Polynucleotide
augcccagacuguucuucuuccaccuccucggcgugugccuccuccucaaccaguucagccgggccguggccgacagcuggauggaggaggucaucaagcucugcggccgcgagcucguccgcgcccagaucgccaucugcggcauguccaccugguccaagcgcucccucucccaggaggacgccccgcagacgccgcgccccgucgccgagaucguccccuccuucaucaacaaggacaccgagacaaucaacaugauguccgaguucgucgccaaccugccgcaggagcucaagcucacccucuccgagaugcagcccgcccugccgcaacuccagcagcacguccccguccucaaggacuccucccuccucuucgaggaguucaagaagcucauccgcaaccgccaguccgaggccgccgacuccagccccuccgagcugaaguaccucggccucgacacccacucccgcaagaagcgccagcucuacuccgcccucgccaacaagugcugccacgucggcugcaccaagcggagccuggcccgcuucugcggcgguggcggaagcggaggcggaggcagcggcggagguggcuccgacauccagaugacccagagcccuagcucucugagcgccuccgucggcgaccgcgucaccaucaccugccgcgccucccgccccaucggcaccaugcucuccugguaccagcagaagcccggcaaggccccgaagcuccucauccucgccuucucccgccuccaguccggcgugccgucccgguucagcggcuccggcagcggaaccgacuucacccugacgaucagcucccugcagccugaggacuucgccaccuacuacugcgcccaggccggcacccaccccaccaccuucggccagggcaccaaggucgagaucaagcgc

SEQ ID NO: 477 - RNA, 924 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcggccgggagcuggugcgggcccagaucgccaucugcggcaugagcaccuggagcaagcggagccugagccaggaggacgcaccccagaccccacggcccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugauccggaaccggcagagcgaggccgccgacagcagccccagcgagcugaaguaccugggccuggacacccacagccggaagaagcggcagcuguacagcgcccuggccaacaagugcugccacgugggcugcaccaagcggagccuggcccgguucugcggcggcggcggcagcggcggcggcggcagcggcggcggcggcagcgacauccagaugacccagagccccagcagccugagcgccagcgugggcgaccgggugaccaucaccugccgggccagccggcccaucggcaccaugcugagcugguaccagcagaagcccggcaaggcccccaagcugcugauccuggccuucagccggcugcagagcggcgugcccagccgguucagcggcagcggcagcggcaccgacuucacccugaccaucagcagccugcagcccgaggacuucgccaccuacuacugcgcccaggccggcacccaccccaccaccuucggccagggcaccaagguggagaucaagcgg

SEQ ID NO: 478 - RNA, 924 nt, Artificial Sequence
  Synthetic Polynucleotide
augccccggcuguucuucuuccaccugcugggcgugugccugcugcugaaccaguucagccgggccguggccgacagcuggauggaggaggugaucaagcugugcgggagggagcuggugagggcgcagaucgcgaucugcgggaugagcacguggagcaagaggagccugagccaggaggacgcgccgcagacgccgaggccgguggcggagaucgugccgagcuucaucaacaaggacacggagacgaucaacaugaugagcgaguucguggcgaaccugccgcaggagcugaagcugacgcugagcgagaugcagccggcgcugccgcagcugcagcagcacgugccggugcugaaggacagcagccugcuguucgaggaguucaagaagcugaucaggaacaggcagagcgaggcggcggacagcagcccgagcgagcugaaguaccuggggcuggacacgcacagcaggaagaagaggcagcuguacagcgcgcuggcgaacaagugcugccacguggggugcacgaagaggagccuggcgagguucugcggaggcggugggagcgguggcggagggagcggcggaggcgggagcgacauccagaugacgcagagcccgagcagccugagcgcgagcgugggggacagggugacgaucacgugcagggcgagcaggccgaucgggacgaugcugagcugguaccagcagaagccggggaaggcgccgaagcugcugauccuggcguucagcaggcugcagagcggggugccgagcagguucagcgggagcgggagcgggacggacuucacgcugacgaucagcagccugcagccggaggacuucgcgacguacuacugcgcgcaggcggggacgcacccgacgacguucgggcaggggacgaagguggagaucaagagg

SEQ ID NO: 479 - RNA, 924 nt, Artificial Sequence
  Synthetic Polynucleotide
augccccggcuguucuucuuccaccugcugggcgugugccugcugcugaaccaguucagccgggccguggccgacagcuggauggaggaggucaucaagcucugcggccgcgagcucguccgcgcccagaucgccaucugcggcauguccaccugguccaagcgcucccucucccaggaggacgcaccccagacaccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugcggcggcggcggcuccggcggcggcggcuccggcggcggcggcuccgacauccagaugacccagucccccuccucccucuccgccuccgucggcgaccgcgucaccaucaccugccgcgccucccgccccaucggcaccaugcucuccugguaccagcagaagcccggcaaggcccccaagcuccucauccucgccuucucccgccuccaguccggcguccccucccgcuucuccggcuccggcuccggcaccgacuucacccucaccaucuccucccuccagcccgaggacuucgccaccuacuacugcgcccaggccggcacccaccccaccaccuucggccagggcaccaaggucgagaucaagcgc

SEQ ID NO: 480 - RNA, 924 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcgguggcggaggcagcggaggugguggcagcggcggagguggcagcgacauccagaugacccagagccccagcagccugagcgccagcgugggcgacagggugaccaucaccugcagggccagcaggcccaucggcaccaugcugagcugguaccagcagaagcccggcaaggcccccaagcugcugauccuggccuucagcaggcugcagagcggcgugcccagcagguucagcggcagcggcagcggcaccgacuucacccugaccaucagcagccugcagcccgaggacuucgccaccuacuacugcgcccaggccggcacccaccccaccaccuucggccagggcaccaagguggagaucaagagg

SEQ ID NO: 481 - RNA, 924 nt, Artificial Sequence; identical to SEQ ID NO: 480
  Synthetic Polynucleotide

SEQ ID NO: 482 - RNA, 924 nt, Artificial Sequence; identical to SEQ ID NO: 5
  Synthetic Polynucleotide

SEQ ID NO: 483 - RNA, 92 nt, Artificial Sequence
  Synthetic Polynucleotide
ucaagcuuuuggacccucguacagaagcuaauacgacucacuauagggaaauaagagagaaaagaagaguaagaagaaauauaagagccacc

SEQ ID NO: 484 - RNA, 164 nt, Artificial Sequence
  Synthetic Polynucleotide
ugauaauaguccauaaaguaggaaacacuacagcuggagccucgguggccaugcuucuugccccuugggccuccccccagccccuccuccccuuccugcacccguaccccccgcauuauuacucacgguacgaguggucuuugaauaaagucugagugggcggc

SEQ ID NO: 485 - RNA, 119 nt, Artificial Sequence
  Synthetic Polynucleotide
ugauaauaggcuggagccucgguggccaugcuucuugccccuugggccuccccccagccccuccuccccuuccugcacccguacccccguggucuuugaauaaagucugagugggcggc

SEQ ID NO: 486 - RNA, 141 nt, Artificial Sequence
  Synthetic Polynucleotide
ugauaauaggcuggagccucgguggccaugcuucuugccccuugggccuccccccagccccuccuccccuuccugcacccguaccccccgcauuauuacucacgguacgaguggucuuugaauaaagucugagugggcggc

SEQ ID NO: 487 - RNA, 142 nt, Artificial Sequence
  Synthetic Polynucleotide
ugauaauaggcuggagccucgguggccaugcuucuugccccuugggccuccccccagccccuccuccccuuccugcacccguacccccuccauaaaguaggaaacacuacaguggucuuugaauaaagucugagugggcggc

SEQ ID NO: 488 - RNA, 829 nt, Artificial Sequence
  Synthetic Polynucleotide
gucccgaccuccaggagagaccaggcccaggaugccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcugagaugaagcuaauugugcacaucucguauaauauucacacauauucuuaaugacauuucacugaugcuucuaucaggucccaucaauucuuagaauaucuaagaaucuuuguuagauauuaggucccaucaauucuuagaauaucuaaacaucuuuguugauguuuagauuuuuuuauuugauguguaagaaaauguucuuugugugauuaaaugacacauuuuuuugcugaaaaaaaaaa

SEQ ID NO: 489 - RNA, 555 nt, Artificial Sequence; identical to SEQ ID NO: 328
  Synthetic Polynucleotide

SEQ ID NO: 490 - RNA, 930 nt, Artificial Sequence
  Synthetic Polynucleotide
gucccgaccuccaggagagaccaggcccaggaugccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcaggugauuuuauucaaacagucucacugggaaucucaccggacggagggaaagcacugagaacaggaagcugcuucacccgagaguuccuuggugcccuuuccaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcugagaugaagcuaauugugcacaucucguauaauauucacacauauucuuaaugacauuucacugaugcuucuaucaggucccaucaauucuuagaauaucuaagaaucuuuguuagauauuaggucccaucaauucuuagaauaucuaaacaucuuuguugauguuuagauuuuuuuauuugauguguaagaaaauguucuuugugugauuaaaugacacauuuuuuugcugaaaaaaaaaa

SEQ ID NO: 491 - RNA, 351 nt, Artificial Sequence
  Synthetic Polynucleotide
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcaggugauuuuauucaaacagucucacugggaaucucaccggacggagggaaagcacugagaacaggaagcugcuucacccgagaguuccuuggugcccuuuccaaauugugccauccuucaucaacaaagauacagaaacca

SEQ ID NO: 492 - RNA, 9 nt, Artificial Sequence
  Synthetic Polynucleotide
ccrccaugg

SEQ ID NO: 493 - RNA, 142 nt, Artificial Sequence
  Synthetic Polynucleotide
ugauaauaggcuggagccucgguggccuagcuucuugccccuugggccuccccccagccccuccuccccuuccugcacccguacccccuccauaaaguaggaaacacuacaguggucuuugaauaaagucugagugggcggc

SEQ ID NO: 494 - RNA, 141 nt, Artificial Sequence
  Synthetic Polynucleotide
ugauaauaggcuggagccucgguggccuagcuucuugccccuugggccuccccccagccccuccuccccuuccugcacccguaccccccgcauuauuacucacgguacgaguggucuuugaauaaagucugagugggcggc

SEQ ID NO: 495 - RNA, 164 nt, Artificial Sequence
  Synthetic Polynucleotide
ugauaauaguccauaaaguaggaaacacuacagcuggagccucgguggccuagcuucuugccccuugggccuccccccagccccuccuccccuuccugcacccguaccccccgcauuauuacucacgguacgaguggucuuugaauaaagucugagugggcggc

SEQ ID NO: 496 - RNA, 188 nt, Artificial Sequence
  Synthetic Polynucleotide
ugauaauaguccauaaaguaggaaacacuacagcuggagccucgguggccuagcuucuugccccuugggccuccauaaaguaggaaacacuacauccccccagccccuccuccccuuccugcacccguacccccuccauaaaguaggaaacacuacaguggucuuugaauaaagucugagugggcggc

SEQ ID NO: 497 - RNA, 140 nt, Artificial Sequence
  Synthetic Polynucleotide
ugauaauaggcuggagccucgguggccaugcuucuugccccuugggccuccccccagccccuccuccccuuccugcacccguacccccaguagugcuuucuacuuuaugguggucuuugaauaaagucugagugggcggc

SEQ ID NO: 498 - RNA, 181 nt, Artificial Sequence
  Synthetic Polynucleotide
ugauaauagaguagugcuuucuacuuuauggcuggagccucgguggccaugcuucuugccccuugggccaguagugcuuucuacuuuauguccccccagccccucuccccuuccugcacccguacccccaguagugcuuucuacuuuaugguggucuuugaauaaagucugagugggcggc

SEQ ID NO: 499 - RNA, 184 nt, Artificial Sequence
  Synthetic Polynucleotide
ugauaauagaguagugcuuucuacuuuauggcuggagccucgguggccaugcuucuugccccuugggccuccauaaaguaggaaacacuacauccccccagccccuccuccccuuccugcacccguacccccaguagugcuuucuacuuuaugguggucuuugaauaaagucugagugggcggc

SEQ ID NO: 500 - RNA, 142 nt, Artificial Sequence
  Synthetic Polynucleotide
ugauaauaguccauaaaguaggaaacacuacagcuggagccucgguggccuagcuucuugccccuugggccuccccccagccccuccuccccuuccugcacccguacccccguggucuuugaauaaagucugagugggcggc

SEQ ID NO: 501 - RNA, 142 nt, Artificial Sequence
  Synthetic Polynucleotide
ugauaauaggcuggagccucgguggcuccauaaaguaggaaacacuacacuagcuucuugccccuugggccuccccccagccccuccuccccuuccugcacccguacccccguggucuuugaauaaagucugagugggcggc

SEQ ID NO: 502 - RNA, 142 nt, Artificial Sequence
  Synthetic Polynucleotide
ugauaauaggcuggagccucgguggccuagcuucuugccccuugggccuccauaaaguaggaaacacuacauccccccagccccuccuccccuuccugcacccguacccccguggucuuugaauaaagucugagugggcggc

SEQ ID NO: 503 - RNA, 142 nt, Artificial Sequence
  Synthetic Polynucleotide
ugauaauaggcuggagccucgguggccuagcuucuugccccuugggccuccccccagccccuccuccccuuccugcacccguacccccaccccuaucacaauuagcauuaaguggucuuugaauaaagucugagugggcggc

SEQ ID NO: 504 - RNA, 188 nt, Artificial Sequence
  Synthetic Polynucleotide
ugauaauagaccccuaucacaauuagcauuaagcuggagccucgguggccuagcuucuugccccuugggccaccccuaucacaauuagcauuaauccccccagccccuccuccccuuccugcacccguacccccaccccuaucacaauuagcauuaaguggucuuugaauaaagucugagugggcggc

SEQ ID NO: 505 - RNA, 188 nt, Artificial Sequence
  Synthetic Polynucleotide
ugauaauagaccccuaucacaauuagcauuaagcuggagccucgguggccuagcuucuugccccuugggccuccauaaaguaggaaacacuacauccccccagccccuccuccccuuccugcacccguacccccaccccuaucacaauuagcauuaaguggucuuugaauaaagucugagugggcggc

SEQ ID NO: 506-538 - skipped (33 entries)

SEQ ID NO: 539 - RNA, 87 nt, Artificial Sequence
  Synthetic Polynucleotide
gacagugcagucacccauaaaguagaaagcacuacuaacagcacuggaggguguaguguuuccuacuuuauggaugaguguacugug

SEQ ID NO: 540 - RNA, 23 nt, Artificial Sequence
  Synthetic Polynucleotide
uguaguguuuccuacuuuaugga

SEQ ID NO: 541 - RNA, 23 nt, Artificial Sequence
  Synthetic Polynucleotide
uccauaaaguaggaaacacuaca

SEQ ID NO: 542 - RNA, 21 nt, Artificial Sequence
  Synthetic Polynucleotide
cauaaaguagaaagcacuacu

SEQ ID NO: 543 - RNA, 21 nt, Artificial Sequence
  Synthetic Polynucleotide
aguagugcuuucuacuuuaug

SEQ ID NO: 544 - DNA, 18 bp, Artificial Sequence
  Synthetic Polynucleotide
attgggcacccgtaaggg

SEQ ID NO: 545 - RNA, 47 nt, Artificial Sequence
  Synthetic Polynucleotide
gggaaauaagagagaaaagaagaguaagaagaaauauaagagccacc

SEQ ID NO: 546 - RNA, 47 nt, Artificial Sequence
  Synthetic Polynucleotide
gggagaucagagagaaaagaagaguaagaagaaauauaagagccacc

SEQ ID NO: 547 - RNA, 145 nt, Artificial Sequence
  Synthetic Polynucleotide
ggaauaaaagucucaacacaacauauacaaaacaaacgaaucucaagcaaucaagcauucuacuucuauugcagcaauuuaaaucauuucuuuuaaagcaaaagcaauuuucugaaaauuuucaccauuuacgaacgauagcaac

SEQ ID NO: 548 - RNA, 42 nt, Artificial Sequence
  Synthetic Polynucleotide
gggagacaagcuuggcauuccgguacuguugguaaagccacc

SEQ ID NO: 549 - RNA, 47 nt, Artificial Sequence; identical to SEQ ID NO: 546
  Synthetic Polynucleotide

SEQ ID NO: 550 - RNA, 145 nt, Artificial Sequence; identical to SEQ ID NO: 547
  Synthetic Polynucleotide

SEQ ID NO: 551 - RNA, 42 nt, Artificial Sequence; identical to SEQ ID NO: 548
  Synthetic Polynucleotide

SEQ ID NO: 552 - RNA, 47 nt, Artificial Sequence
  Synthetic Polynucleotide
gggaauuaacagagaaaagaagaguaagaagaaauauaagagccacc

SEQ ID NO: 553 - RNA, 47 nt, Artificial Sequence
  Synthetic Polynucleotide
gggaaauuagacagaaaagaagaguaagaagaaauauaagagccacc

SEQ ID NO: 554 - RNA, 47 nt, Artificial Sequence
  Synthetic Polynucleotide
gggaaauaagagaguaaagaacaguaagaagaaauauaagagccacc

SEQ ID NO: 555 - RNA, 47 nt, Artificial Sequence
  Synthetic Polynucleotide
gggaaaaaagagagaaaagaagacuaagaagaaauauaagagccacc

SEQ ID NO: 556 - RNA, 47 nt, Artificial Sequence
  Synthetic Polynucleotide
gggaaauaagagagaaaagaagaguaagaagauauauaagagccacc

SEQ ID NO: 557 - RNA, 47 nt, Artificial Sequence
  Synthetic Polynucleotide
gggaaauaagagacaaaacaagaguaagaagaaauauaagagccacc

SEQ ID NO: 558 - RNA, 47 nt, Artificial Sequence
  Synthetic Polynucleotide
gggaaauuagagaguaaagaacaguaaguagaauuaaaagagccacc

SEQ ID NO: 559 - RNA, 47 nt, Artificial Sequence
  Synthetic Polynucleotide
gggaaauaagagagaauagaagaguaagaagaaauauaagagccacc

SEQ ID NO: 560 - RNA, 47 nt, Artificial Sequence
  Synthetic Polynucleotide
gggaaauaagagagaaaagaagaguaagaagaaaauuaagagccacc

SEQ ID NO: 561 - RNA, 47 nt, Artificial Sequence
  Synthetic Polynucleotide
gggaaauaagagagaaaagaagaguaagaagaaauuuaagagccacc

SEQ ID NO: 562 - RNA, 92 nt, Artificial Sequence; identical to SEQ ID NO: 483
  Synthetic Polynucleotide

SEQ ID NO: 563 - RNA, 142 nt, Artificial Sequence
  Synthetic Polynucleotide
ugauaauaguccauaaaguaggaaacacuacagcuggagccucgguggccaugcuucuugccccuugggccuccccccagccccuccuccccuuccugcacccguacccccguggucuuugaauaaagucugagugggcggc

SEQ ID NO: 564 - RNA, 142 nt, Artificial Sequence
  Synthetic Polynucleotide
ugauaauaggcuggagccucgguggcuccauaaaguaggaaacacuacacaugcuucuugccccuugggccuccccccagccccuccuccccuuccugcacccguacccccguggucuuugaauaaagucugagugggcggc

SEQ ID NO: 565 - RNA, 142 nt, Artificial Sequence
  Synthetic Polynucleotide
ugauaauaggcuggagccucgguggccaugcuucuugccccuuccauaaaguaggaaacacuacaugggccuccccccagccccuccuccccuuccugcacccguacccccguggucuuugaauaaagucugagugggcggc

SEQ ID NO: 566 - RNA, 142 nt, Artificial Sequence
  Synthetic Polynucleotide
ugauaauaggcuggagccucgguggccaugcuucuugccccuugggccuccccccaguccauaaaguaggaaacacuacaccccuccuccccuuccugcacccguacccccguggucuuugaauaaagucugagugggcggc

SEQ ID NO: 567 - RNA, 142 nt, Artificial Sequence
  Synthetic Polynucleotide
ugauaauaggcuggagccucgguggccaugcuucuugccccuugggccuccccccagccccuccuccccuucuccauaaaguaggaaacacuacacugcacccguacccccguggucuuugaauaaagucugagugggcggc

SEQ ID NO: 568 - RNA, 142 nt, Artificial Sequence; identical to SEQ ID NO: 487
  Synthetic Polynucleotide

SEQ ID NO: 569 - RNA, 142 nt, Artificial Sequence
  Synthetic Polynucleotide
ugauaauaggcuggagccucgguggccaugcuucuugccccuugggccuccccccagccccuccuccccuuccugcacccguacccccguggucuuugaauaaaguuccauaaaguaggaaacacuacacugagugggcggc

SEQ ID NO: 570 - RNA, 371 nt, Artificial Sequence
  Synthetic Polynucleotide
gcgccugcccaccugccaccgacugcuggaacccagccagugggagggccuggcccaccagaguccugcucccucacuccucgccccgcccccugucccagagucccaccugggggcucucuccacccuucucagaguuccaguuucaaccagaguuccaaccaaugggcuccauccucuggauucuggccaaugaaauaucucccuggcaggguccucuucuuuucccagagcuccaccccaaccaggagcucuaguuaauggagagcucccagcacacucggagcuugugcuuugucuccacgcaaagcgauaaauaaaagcauugguggccuuuggucuuugaauaaagccugaguaggaagucuaga

SEQ ID NO: 571 - RNA, 568 nt, Artificial Sequence
  Synthetic Polynucleotide
gccccugccgcucccacccccacccaucugggccccggguucaagagagagcggggucugaucucguguagccauauagaguuugcuucugagugucugcuuuguuuaguagaggugggcaggaggagcugaggggcuggggcugggguguugaaguuggcuuugcaugcccagcgaugcgccucccugugggaugucaucacccugggaaccgggaguggcccuuggcucacuguguucugcaugguuuggaucugaauuaauuguccuuucuucuaaaucccaaccgaacuucuuccaaccuccaaacuggcuguaaccccaaauccaagccauuaacuacaccugacaguagcaauugucugauuaaucacuggccccuugaagacagcagaaugucccuuugcaaugaggaggagaucugggcugggcgggccagcuggggaagcauuugacuaucuggaacuugugugugccuccucagguauggcagugacucaccugguuuuaauaaaacaaccugcaacaucucauggucuuugaauaaagccugaguaggaagucuaga

SEQ ID NO: 572 - RNA, 289 nt, Artificial Sequence
  Synthetic Polynucleotide
acacacuccaccuccagcacgcgacuucucaggacgacgaaucuucucaaugggggggcggcugagcuccagccaccccgcagucacuuucuuuguaacaacuuccguugcugccaucguaaacugacacaguguuuauaacguguacauacauuaacuuauuaccucauuuuguuauuuuucgaaacaaagcccuguggaagaaaauggaaaacuugaagaagcauuaaagucauucuguuaagcugcguaaauggucuuugaauaaagccugaguaggaagucuaga

SEQ ID NO: 573 - RNA, 379 nt, Artificial Sequence
  Synthetic Polynucleotide
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucuaauagagugguacagcacuguuauuuuucaaagauguguugcuauccugaaaauucuguagguucuguggaaguuccaguguucucucuuauuccacuucgguagaggauuucuaguuucuugugggcuaauuaaauaaaucauuaauacucuucuaauggucuuugaauaaagccugaguaggaagucuaga

SEQ ID NO: 574 - RNA, 118 nt, Artificial Sequence
  Synthetic Polynucleotide
gcugccuucugcggggcuugccuucuggccaugcccuucuucucucccuugcaccuguaccucuuggucuuugaauaaagccugaguaggaaggcggccgcucgagcaugcaucuaga

SEQ ID NO: 575 - RNA, 908 nt, Artificial Sequence
  Synthetic Polynucleotide
gccaagcccuccccaucccauguauuuaucucuauuuaauauuuaugucuauuuaagccucauauuuaaagacagggaagagcagaacggagccccaggccucuguguccuucccugcauuucugaguuucauucuccugccuguagcagugagaaaaagcuccuguccucccauccccuggacugggagguagauagguaaauaccaaguauuuauuacuaugacugcuccccagcccuggcucugcaaugggcacugggaugagccgcugugagccccugguccugaggguccccaccugggacccuugagaguaucaggucucccacgugggagacaagaaaucccuguuuaauauuuaaacagcaguguuccccaucuggguccuugcaccccucacucuggccucagccgacugcacagcggccccugcauccccuuggcugugaggccccuggacaagcagagguggccagagcugggaggcauggcccuggggucccacgaauuugcuggggaaucucguuuuucuucuuaagacuuuugggacaugguuugacucccgaacaucaccgacgcgucuccuguuuuucuggguggccucgggacaccugcccugcccccacgagggucaggacugugacucuuuuuagggccaggcaggugccuggacauuugccuugcuggacggggacuggggaugugggagggagcagacaggaggaaucaugucaggccugugugugaaaggaagcuccacugucacccuccaccucuucaccccccacucaccaguguccccuccacugucacauuguaacugaacuucaggauaauaaaguguuugccuccauggucuuugaauaaagccugaguaggaaggcggccgcucgagcaugcaucuaga

SEQ ID NO: 576 - RNA, 835 nt, Artificial Sequence
  Synthetic Polynucleotide
acucaaucuaaauuaaaaaagaaagaaauuugaaaaaacuuucucuuugccauuucuucuucuucuuuuuuaacugaaagcugaauccuuccauuucuucugcacaucuacuugcuuaaauugugggcaaaagagaaaaagaaggauugaucagagcauugugcaauacaguuucauuaacuccuucccccgcucccccaaaaauuugaauuuuuuuuucaacacucuuacaccuguuauggaaaaugucaaccuuuguaagaaaaccaaaauaaaaauugaaaaauaaaaaccauaaacauuugcaccacuuguggcuuuugaauaucuuccacagagggaaguuuaaaacccaaacuuccaaagguuuaaacuaccucaaaacacuuucccaugagugugauccacauuguuaggugcugaccuagacagagaugaacugagguccuuguuuuguuuuguucauaauacaaaggugcuaauuaauaguauuucagauacuugaagaauguugauggugcuagaagaauuugagaagaaauacuccuguauugaguuguaucgugugguguauuuuuuaaaaaauuugauuuagcauucauauuuuccaucuuauucccaauuaaaaguaugcagauuauuugcccaaaucuucuucagauucagcauuuguucuuugccagucucauuuucaucuucuuccaugguuccacagaagcuuuguuucuugggcaagcagaaaaauuaaauuguaccuauuuuguauaugugagauguuuaaauaaauugugaaaaaaaugaaauaaagcauguuugguuuuccaaaagaacauau

SEQ ID NO: 577 - RNA, 297 nt, Artificial Sequence
  Synthetic Polynucleotide
cgccgccgcccgggccccgcagucgagggucgugagcccaccccguccauggugcuaagcgggcccgggucccacacggccagcaccgcugcucacucggacgacgcccugggccugcaccucuccagcuccucccacgggguccccguagccccggcccccgcccagccccaggucuccccaggcccuccgcaggcugcccggccucccucccccugcagccaucccaaggcuccugaccuaccuggccccugagcucuggagcaagcccugacccaauaaaggcuuugaacccau

SEQ ID NO: 578 - RNA, 602 nt, Artificial Sequence
  Synthetic Polynucleotide
ggggcuagagcccucuccgcacagcguggagacggggcaaggagggggguuauuaggauuggugguuuuguuuugcuuuguuuaaagccgugggaaaauggcacaacuuuaccucugugggagaugcaacacugagagccaaggggugggaguugggauaauuuuuauauaaaagaaguuuuuccacuuugaauugcuaaaaguggcauuuuuccuaugugcagucacuccucucauuucuaaaauagggacguggccaggcacgguggcucaugccuguaaucccagcacuuugggaggccgaggcaggcggcucacgaggucaggagaucgagacuauccuggcuaacacgguaaaacccugucucuacuaaaaguacaaaaaauuagcugggcgugguggugggcaccuguagucccagcuacucgggaggcugaggcaggagaaaggcaugaauccaagaggcagagcuugcagugagcugagaucacgccauugcacuccagccugggcaacaguguuaagacucugucucaaauauaaauaaauaaauaaauaaauaaauaaauaaauaaaaauaaagcgagauguugcccucaaa

SEQ ID NO: 579 - RNA, 785 nt, Artificial Sequence
  Synthetic Polynucleotide
ggcccugccccgucggacugcccccagaaagccuccugcccccugccagugaaguccuucagugagccccuccccagccagcccuucccuggccccgccggauguauaaauguaaaaaugaaggaauuacauuuuauaugugagcgagcaagccggcaagcgagcacaguauuauuucuccauccccucccugccugcuccuuggcacccccaugcugccuucagggagacaggcagggagggcuuggggcugcaccuccuacccucccaccagaacgcaccccacugggagagcugguggugcagccuuccccucccuguauaagacacuuugccaaggcucuccccucucgccccaucccugcuugcccgcucccacagcuuccugagggcuaauucugggaagggagaguucuuugcugccccugucuggaagacguggcucugggugagguaggcgggaaaggauggaguguuuuaguucuugggggaggccaccccaaaccccagccccaacuccaggggcaccuaugagauggccaugcucaaccccccucccagacaggcccucccugucuccagggcccccaccgagguucccagggcuggagacuuccucugguaaacauuccuccagccuccccuccccuggggacgccaaggaggugggccacacccaggaagggaaagcgggcagccccguuuuggggacgugaacguuuuaauaauuuuugcugaauuccuuuacaacuaaauaacacagauauuguuauaaauaaaauugu

SEQ ID NO: 580 - RNA, 3001 nt, Artificial Sequence
  Synthetic Polynucleotide
auauuaaggaucaagcuguuagcuaauaaugccaccucugcaguuuugggaacaggcaaauaaaguaucaguauacauggugauguacaucuguagcaaagcucuuggagaaaaugaagacugaagaaagcaaagcaaaaacuguauagagagauuuuucaaaagcaguaaucccucaauuuuaaaaaaggauugaaaauucuaaaugucuuucugugcauauuuuuuguguuaggaaucaaaaguauuuuauaaaaggagaaagaacagccucauuuuagauguaguccuguuggauuuuuuaugccuccucaguaaccagaaauguuuuaaaaaacuaaguguuuaggauuucaagacaacauuauacauggcucugaaauaucugacacaauguaaacauugcaggcaccugcauuuuauguuuuuuuuuucaacaaaugugacuaauuugaaacuuuuaugaacuucugagcuguccccuugcaauucaaccgcaguuugaauuaaucauaucaaaucaguuuuaauuuuuuaaauuguacuucagagucuauauuucaagggcacauuuucucacuacuauuuuaauacauuaaaggacuaaauaaucuuucagagaugcuggaaacaaaucauuugcuuuauauguuucauuagaauaccaaugaaacauacaacuugaaaauuaguaauaguauuuuugaagaucccauuucuaauuggagaucucuuuaauuucgaucaacuuauaauguguaguacuauauuaagugcacuugaguggaauucaacauuugacuaauaaaaugaguucaucauguuggcaagugauguggcaauuaucucuggugacaaaagaguaaaaucaaauauuucugccuguuacaaauaucaaggaagaccugcuacuaugaaauagaugacauuaaucugucuucacuguuuauaauacggauggauuuuuuuucaaaucaguguguguuuugaggucuuauguaauugaugacauuugagagaaaugguggcuuuuuuuagcuaccucuuuguucauuuaagcaccaguaaagaucaugucuuuuuauagaaguguagauuuucuuugugacuuugcuaucgugccuaaagcucuaaauauaggugaaugugugaugaauacucagauuauuugucucucuauauaauuaguuugguacuaaguuucucaaaaaauuauuaacacaugaaagacaaucucuaaaccagaaaaagaaguaguacaaauuuuguuacuguaaugcucgcguuuagugaguuuaaaacacacaguaucuuuugguuuuauaaucaguuucuauuuugcugugccugagauuaagaucuguguaugugugugugugugugugugcguuuguguguuaaagcagaaaagacuuuuuuaaaaguuuuaagugauaaaugcaauuuguuaauugaucuuagaucacuaguaaacucagggcugaauuauaccauguauauucuauuagaagaaaguaaacaccaucuuuauuccugcccuuuuucuucucucaaaguaguuguaguuauaucuagaaagaagcaauuuugauuucuugaaaagguaguuccugcacucaguuuaaacuaaaaauaaucauacuuggauuuuauuuauuuuugucauaguaaaaauuuuaauuuauauauauuuuuauuuaguauuaucuuauucuuugcuauuugccaauccuuugucaucaauuguguuaaaugaauugaaaauucaugcccuguucauuuuauuuuacuuuauugguuaggauauuuaaaggauuuuuguauauauaauuucuuaaauuaauauuccaaaagguuaguggacuuagauuauaaauuauggcaaaaaucuaaaaacaacaaaaaugauuuuuauacauucuauuucauuauuccucuuuuuccaauaagucauacaauugguagauaugacuuauuuuauuuuuguauuauucacuauaucuuuaugauauuuaaguauaaauaauuaaaaaaauuuauuguaccuuauagucugucaccaaaaaaaaaaaauuaucuguagguagugaaaugcuaauguugauuugucuuuaagggcuuguuaacuauccuuuauuuucucauuugucuuaaauuaggaguuuguguuuaaauuacucaucuaagcaaaaaauguauauaaaucccauuacuggguauauacccaaaggauuauaaaucaugcugcuauaaagacacaugcacacguauguuuauugcagcacuauucacaauagcaaagacuuggaaccaacccaaauguccaucaaugauagacuugauuaagaaaaugugcacauauacaccauggaauacuaugcagccauaaaaaaggaugaguucauguccuuuguagggacauggauaaagcuggaaaccaucauucugagcaaacuauugcaaggacagaaaaccaaacacugcauguucucacucauaggugggaauugaacaaugagaacacuuggacacaagguggggaacaccacacaccagggccugucaugggguggggggaguggggagggauagcauuaggagauauaccuaauguaaaugaugaguuaaugggugcagcacaccaacauggcacauguauacauauguagcaaaccugcacguugugcacauguacccuagaacuuaaaguauaauuaaaaaaaaaaagaaaacagaagcuauuuauaaagaaguuauuugcugaaauaaaugugaucuuucccauuaaaaaaauaaagaaauuuugggguaaaaaaacacaauauauuguauucuugaaaaauucuaagagaguggaugugaaguguucucaccacaaaagugauaacuaauugagguaaugcacauauuaauuagaaagauuuugucauuccacaauguauauauacuuaaaaauauguuauacacaauaaauacauacauuaaaaaauaaguaaaugua

SEQ ID NO: 581 - RNA, 1037 nt, Artificial Sequence
  Synthetic Polynucleotide
cccacccugcacgccggcaccaaacccuguccucccaccccuccccacucaucacuaaacagaguaaaaugugaugcgaauuuucccgaccaaccugauucgcuagauuuuuuuuaaggaaaagcuuggaaagccaggacacaacgcugcugccugcuuugugcaggguccuccggggcucagcccugaguuggcaucaccugcgcagggcccucuggggcucagcccugagcuagugucaccugcacagggcccucugaggcucagcccugagcuggcgucaccugugcagggcccucuggggcucagcccugagcuggccucaccuggguuccccaccccgggcucuccugcccugcccuccugcccgcccucccuccugccugcgcagcuccuucccuaggcaccucugugcugcaucccaccagccugagcaagacgcccucucggggccugugccgcacuagccucccucuccucuguccccauagcugguuuuucccaccaauccucaccuaacaguuacuuuacaauuaaacucaaagcaagcucuucuccucagcuuggggcagccauuggccucugucucguuuugggaaaccaaggucaggaggccguugcagacauaaaucucggcgacucggccccgucuccugaggguccugcuggugaccggccuggaccuuggcccuacagcccuggaggccgcugcugaccagcacugaccccgaccucagagaguacucgcaggggcgcuggcugcacucaagacccucgagauuaacggugcuaaccccgucugcuccucccucccgcagagacuggggccuggacuggacaugagagccccuuggugccacagagggcugugucuuacuagaaacaacgcaaaccucuccuuccucagaauagugauguguucgacguuuuaucaaaggcccccuuucuauguucauguuaguuuugcuccuucuguguuuuuuucugaaccauauccauguugcugacuuuuccaaauaaagguuuucacuccucuc

SEQ ID NO: 582 - RNA, 577 nt, Artificial Sequence
  Synthetic Polynucleotide
agaggccugccuccagggcuggacugaggccugagcgcuccugccgcagagcuggccgcgccaaauaaugucucugugagacucgagaacuuucauuuuuuuccaggcugguucggauuugggguggauuuugguuuuguuccccuccuccacucucccccacccccuccccgcccuuuuuuuuuuuuuuuuuuaaacugguauuuuaucuuugauucuccuucagcccucaccccugguucucaucuuucuugaucaacaucuuuucuugccucuguccccuucucucaucucuuagcuccccuccaaccuggggggcagugguguggagaagccacaggccugagauuucaucugcucuccuuccuggagcccagaggagggcagcagaaggggguggugucuccaaccccccagcacugaggaagaacggggcucuucucauuucaccccucccuuucuccccugcccccaggacugggccacuucuggguggggcagugggucccagauuggcucacacugagaauguaagaacuacaaacaaaauuucuauuaaauuaaauuuugugucucc

SEQ ID NO: 583 - RNA, 2212 nt, Artificial Sequence
  Synthetic Polynucleotide
cucccuccaucccaaccuggcucccucccacccaaccaacuuuccccccaacccggaaacagacaagcaacccaaacugaacccccucaaaagccaaaaaaugggagacaauuucacauggacuuuggaaaauauuuuuuuccuuugcauucaucucucaaacuuaguuuuuaucuuugaccaaccgaacaugaccaaaaaccaaaagugcauucaaccuuaccaaaaaaaaaaaaaaaaaaagaauaaauaaauaacuuuuuaaaaaaggaagcuugguccacuugcuugaagacccaugcggggguaagucccuuucugcccguugggcuuaugaaaccccaaugcugcccuuucugcuccuuucuccacaccccccuuggggccuccccuccacuccuucccaaaucugucuccccagaagacacaggaaacaauguauugucugcccagcaaucaaaggcaaugcucaaacacccaaguggcccccacccucagcccgcuccugcccgcccagcacccccaggcccugggggaccugggguucucagacugccaaagaagccuugccaucuggcgcucccauggcucuugcaacaucuccccuucguuuuugagggggucaugccgggggagccaccagccccucacuggguucggaggagagucaggaagggccacgacaaagcagaaacaucggauuuggggaacgcgugucaaucccuugugccgcagggcugggcgggagagacuguucuguuccuuguguaacuguguugcugaaagacuaccucguucuugucuugaugugucaccggggcaacugccugggggcggggaugggggcaggguggaagcggcuccccauuuuauaccaaaggugcuacaucuaugugaugggugggguggggagggaaucacuggugcuauagaaauugagaugcccccccaggccagcaaauguuccuuuuuguucaaagucuauuuuuauuccuugauauuuuucuuuuuuuuuuuuuuuuuuuguggauggggacuugugaauuuuucuaaaggugcuauuuaacaugggaggagagcgugugcggcuccagcccagcccgcugcucacuuuccacccucucuccaccugccucuggcuucucaggccucugcucuccgaccucucuccucugaaacccuccuccacagcugcagcccauccucccggcucccuccuagucuguccugcguccucuguccccggguuucagagacaacuucccaaagcacaaagcaguuuuucccccuaggggugggaggaagcaaaagacucuguaccuauuuuguauguguauaauaauuugagauguuuuuaauuauuuugauugcuggaauaaagcauguggaaaugacccaaacauaauccgcaguggccuccuaauuuccuucuuuggaguugggggagggguagacauggggaaggggcuuuggggugaugggcuugccuuccauuccugcccuuucccuccccacuauucucuucuagaucccuccauaaccccacuccccuuucucucacccuucuuauaccgcaaaccuuucuacuuccucuuucauuuucuauucuugcaauuuccuugcaccuuuuccaaauccucuucuccccugcaauaccauacaggcaauccacgugcacaacacacacacacacucuucacaucugggguuguccaaaccucauacccacuccccuucaagcccauccacucuccacccccuggaugcccugcacuugguggcggugggaugcucauggauacugggagggugaggggaguggaacccgugaggaggaccugggggccucuccuugaacugacaugaagggucaucuggccucugcucccuucucacccacgcugaccuccugccgaaggagcaacgcaacaggagaggggucugcugagccuggcgagggucugggagggaccaggaggaaggcgugcucccugcucgcuguccuggcccugggggagugagggagacagacaccugggagagcuguggggaaggcacucgcaccgugcucuugggaaggaaggagaccuggcccugcucaccacggacugggugccucgaccuccugaauccccagaacacaaccccccugggcugggguggucuggggaaccaucgugcccccgccucccgccuacuccuuuuuaagcuu

SEQ ID NO: 584 - RNA, 729 nt, Artificial Sequence
  Synthetic Polynucleotide
uuggccaggccugacccucuuggaccuuucuucuuugccgacaaccacugcccagcagccucugggaccucggggucccagggaacccaguccagccuccuggcuguugacuucccauugcucuuggagccaccaaucaaagagauucaaagagauuccugcaggccagaggcggaacacaccuuuauggcuggggcucuccgugguguucuggacccagccccuggagacaccauucacuuuuacugcuuuguagugacucgugcucuccaaccugucuuccugaaaaaccaaggcccccuucccccaccucuuccauggggugagacuugagcagaacaggggcuuccccaaguugcccagaaagacugucugggugagaagccauggccagagcuucucccaggcacagguguugcaccagggacuucugcuucaaguuuugggguaaagacaccuggaucagacuccaagggcugcccugagucugggacuucugccuccauggcuggucaugagagcaaaccguaguccccuggagacagcgacuccagagaaccucuugggagacagaagaggcaucugugcacagcucgaucuucuacuugccuguggggaggggagugacagguccacacaccacacugggucacccuguccuggaugccucugaagagagggacagaccgucagaaacuggagaguuucuauuaaaggucauuuaaacca

SEQ ID NO: 585 - RNA, 847 nt, Artificial Sequence
  Synthetic Polynucleotide
uccuccgggaccccagcccucaggauuccugaugcuccaaggcgacugaugggcgcuggaugaaguggcacagucagcuucccugggggcuggugucauguugggcuccuggggcgggggcacggccuggcauuucacgcauugcugccaccccagguccaccugucuccacuuucacagccuccaagucuguggcucuucccuucuguccuccgaggggcuugccuucucucguguccagugaggugcucagugaucggcuuaacuuagagaagcccgcccccuccccuucuccgucugucccaagagggucugcucugagccugcguuccuagguggcucggccucagcugccuggguuguggccgcccuagcauccuguaugcccacagcuacuggaauccccgcugcugcuccgggccaagcuucugguugauuaaugagggcaugggguggucccucaagaccuuccccuaccuuuuguggaaccagugaugccucaaagacaguguccccuccacagcugggugccaggggcaggggauccucaguauagccggugaacccugauaccaggagccugggccucccugaaccccuggcuuccagccaucucaucgccagccuccuccuggaccucuuggcccccagccccuuccccacacagccccagaagggucccagagcugaccccacuccaggaccuaggcccagccccucagccucaucuggagccccugaagaccagucccacccaccuuucuggccucaucugacacugcuccgcauccugcuguguguccuguuccauguuccgguuccauccaaauacacuuucuggaacaaa

SEQ ID NO: 586 - RNA, 110 nt, Artificial Sequence
  Synthetic Polynucleotide
gcuggagccucgguggccaugcuucuugccccuugggccuccccccagccccuccuccccuuccugcacccguacccccguggucuuugaauaaagucugagugggcggc

SEQ ID NO: 587 - RNA, 119 nt, Artificial Sequence
  Synthetic Polynucleotide
ugauaauaggcuggagccucgguggccuagcuucuugccccuugggccuccccccagccccuccuccccuuccugcacccguacccccguggucuuugaauaaagucugagugggcggc

SEQ ID NO: 588 - protein, 5 aa, Artificial Sequence
  Synthetic Polypeptide
GGGGS

SEQ ID NO: 589 - protein, 15 aa, Artificial Sequence
  Synthetic Polypeptide
GGGGSGGGGSGGGGS

What is claimed is:

1. A composition comprising an mRNA polynucleotide having an open reading frame encoding a polypeptide comprising at least one human relaxin protein formulated in an ionizable lipid nanoparticle, wherein the ionizable lipid nanoparticle comprises an ionizable lipid of Compound 18 having the structure:

a salt or a stereoisomer thereof, or any combination thereof; and
wherein the relaxin protein is a relaxin fusion protein comprising an immunoglobulin (Ig) variable chain fragment.

2. The composition of claim 1, wherein the Ig fragment comprises a variable light chain fragment.

3. The composition of claim 2, wherein the variable light chain fragment comprises a VLκ IgG region.

4. The composition of claim 1, wherein the relaxin protein comprises an amino acid sequence that is 70%-100% identical to the sequence of SEQ ID NO:1.

5. The composition of claim 1, wherein the relaxin protein comprises an amino acid sequence that is 85%-100% identical to the sequence of SEQ ID NO:1.

6. The composition of claim 1, wherein the composition is a unit dosage form having a dosage of 25 micrograms to 400 micrograms of the mRNA polynucleotide for a dose of up to 2 mg/kg in a human subject.

7. The composition of claim 1, wherein the open reading frame is codon optimized.

8. The composition of claim 1, wherein the mRNA comprises at least one chemical modification.

9. The composition of claim 8, wherein the chemical modification is selected from pseudouridine, 1-methylpseudouridine, 1-ethyl pseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine and 2'-O-methyl uridine.

10. The composition of claim 1, wherein the mRNA polynucleotide formulated in the ionizable lipid nanoparticle and administered by intravenous infusion or subcutaneous injection has a therapeutic index of greater than 60% of the therapeutic index of the mRNA polynucleotide alone.

11. The composition of claim 1, wherein the mRNA polynucleotide formulated in the ionizable lipid nanoparticle and administered by intravenous infusion or subcutaneous injection has a therapeutic index of greater than 80% of the therapeutic index of the mRNA polynucleotide alone.

12. The composition of claim 1, wherein the ionizable lipid nanoparticle comprises a molar ratio of about 20-60% ionizable lipid, about 5-25% non-cationic lipid, about 25-55% sterol, and about 0.5-15% PEG-modified lipid.

13. The composition of claim 1, wherein the ionizable lipid nanoparticle has a polydispersity value of less than 0.4.

14. The composition of claim 1, wherein the ionizable lipid nanoparticle has a net neutral charge at a neutral pH.

15. The composition of claim 1, wherein the mRNA comprises at least one chemical modification and wherein the chemical modification is N1-methylpseudouridine.

16. The composition of claim 1, wherein the relaxin protein comprises an amino acid sequence that is 90%-100% identical to the sequence of SEQ ID NO:1.

17. The composition of claim 1, wherein the relaxin protein comprises an amino acid sequence that is 70%-100% identical to the sequence of SEQ ID NO:6.

18. The composition of claim 1, wherein the relaxin protein comprises an amino acid sequence that is 85%-100% identical to the sequence of SEQ ID NO:6.

19. The composition of claim 1, wherein the relaxin protein comprises an amino acid sequence that is 90%-100% identical to the sequence of SEQ ID NO:6.

20. The composition of claim 1, wherein the mRNA polynucleotide comprises the open reading frame of SEQ ID NO:5.

21. The composition of claim 1, wherein the mRNA polynucleotide comprises a polynucleotide sequence that is at least 95% identical to the sequence of SEQ ID NO:5.

* * * * *